United States Patent 10,760,091 (GENES AND USES FOR PLANT ENHANCEMENT) - sequence listing, part 16

SEQ ID NO: 67630 - protein, 439 aa, Oryza sativa
METEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGPGAPRGAYPGPKGGGGKT

SEQ ID NO: 67631 - protein, 337 aa, Oryza sativa
MAGGVSSVEVVKDGATGLEKLVLREAHGCSVQVDPLSSTLAFSCNVDKLFIGGGHHDAIVSCGFDWPFAIILSILGNVILDNLTGSLLSFFFLRNGQFGNHGVLEQHGFARNRLWSVDETPPPFPATTSNCHIDLILKQSPEDLKIWPHSFEFRLRVALSPTGDLMLTSRIKNTNADGKPFKFGFSYNTYFSVSDISEVRVEGLETLDYIDNLQCGKRCTEQGDAVVFESEAEKVYLSAPPKIVIIDHDKKRTFELRKEGLPDVVVWNPWDRKAKTILDFGEEEYKCMLCVGAANAEKPITLRPGEEWQGRQEISVVPSSYSSGQWDPEIIHRIQDI

SEQ ID NO: 67632 - protein, 292 aa, Aspergillus nidulans FGSC A4
MSEITHPTIKDGWFSEQSEMWPGQAMNLRVNQILHHEKSKYQDVLVFESSDYGTVLVLDNVIQCTERDEFSYQEMITHLAMNSHPNPKKVLVIGGGDGGVLREVVKHETVEEAILCDIDEAVIRVSKKYLPGMSIGFQHPNVKVHVGDGFEFLKQRQNEFDVIITDSSDPEGPAESLFQKPYFELLRDALRDGGVITTQAENQWLHLPLIADLKKACNEVFPVAEYAYTTIPTYPSGQIGFMVCCKDANRNVKEPVRTWSREEEERLCRYYNQDIHRASFVLPNFARKALGN

SEQ ID NO: 67633 - protein, 208 aa, Bacillus halodurans C-125
MKPIRIGIGGPVGSGKTHLVEQLTRAMHESYELAVITNDIYTKEDAQFLVKHGILPEDRIIGVETGGCPHTAIREDASMNFEAIHELKQRFTNLDIIFVESGGDNLSATFSPELVDGFIYVIDVAEGQDIPRKGGPGVTRSDLLVINKIDLAPYVEVDLDIMEEDAKQARGERPFVFTDQKRGKGIETIIDWIKRELLLEDMVKEPSV

SEQ ID NO: 67634 - protein, 692 aa, Aspergillus nidulans FGSC A4
MGYTELDQLAINTIRLLAVDATAKANSGHPGAPMGMAPVAHVLFNKFMKFNPKNPEWANRDRFVLSYEAHFSCDNGHGCMLQYALLHLFGYGISMDDLKAFRQLDSITPGHPEAHDTPGIEVTTGPLGQGFANAVGLAIAQAHSGGVFNKPGYNLFDNYTYCFFGDGCAMEGVASEAASTAGHLKLGNLIAIYDDNHISIDGDTKCAFTEDVTKRFEAYGWHVVWVKDGDNDLEGIEAAIKEAQAVKDKPSMIRLTTTIGFGSKLQGTGGVHGNPLKADDIEGVKKRFGFDPAQSFVVPQQVYDLYHKHAEEGAAQEQEWNQLLQKYAGEYPNEHADLTRRLSGKLPEGWEKSLPVYKPSDPAIASRKLSEAVLEKIHSVIPELLSGSADLTGSNNTRWKNAVDFQPPEYGIGEWSGRYLRYGVREHAMAAIMNGLAAYGTVIPAAGTFLNFVSYAAGAVRLSALSRVRAIHVATHDSIGLGEDGPTHQPIETLAHFRALPNCMVWRPADGNETSAAYYSALTAKHTPSILALTRQNLPQLENSSIEAALKGAYPVFEAADAKVTIISTGSEVSICIDAAKYLQEKHGVVARVVSIPCFEVFDAQDKEYRLKVLPDGIPILSVEVCSTMGWERYSHEQFGLNRFGASGPYKEVYAKFEFTPEGISKRALATIDFYKGVPVRSPINRAFQQIL

SEQ ID NO: 67635 - protein, 560 aa, Pseudomonas fluorescens PfO-1
MLQTRVIPPAEGAYQYPLLIKRLLMSGARYEKTREIIYRDQLRYSYPTLIERVAQLANVLTAAGVKAGDTVAVMDWDSHRYLECMFAIPMIGAVIHTINVRLSPEQILYTMNHAEDRFVLVNSEFVGLYQAIAPHLTTVEKTLLLTDLPEKTADLPNLVGEYEQLLAAASPQYDFLDFDENSVATTFYTTGTTGNPKGVYFTHRQLVLHTMGVSTIMGAIDSVRLLGTNDVYMPITPMFHVHAWGLPYVATMLGLKQVYPGRYDPEFLVELWRKEKVTFSHCVPTILQMVLNAKGAQGTDFGGWKIVIGGSALNRTLYETAKSKGIQLTAAYGMSETGPLVSCAHLNDELMAGTEDERTTYRIKAGVPGPLVEAAIVDTEGNFLPADGETQGELVLRAPWLTEGYFNEPQKGAELWAGGWLHTGDVATLDAMGVIDIRDRIKDVIKTGGEWISSLDLEDLISRHVAVREVAVVGIADPQWGERPFALLVVREGHAIGARELKEHLKPFVELGHLSKWAIPSQIALVTEIPKTSVGKLDKKRIRLDITEWQANNSTFLSTL

SEQ ID NO: 67636 - protein, 130 aa, Methanocaldococcus jannaschii
  misc_feature (41)..(41): Xaa can be any naturally occurring amino acid
  misc_feature (111)..(111): Xaa can be any naturally occurring amino acid
MSLMDPLANALNHISNCERVGKKVVYIKPASKLIGRVLKVXQDNGYIGEFEFIEDGRAGIFKVELIGKINKCGAIKPRFPVKKFGYEKFEKRYLPARDFGILIVSTTQGVXSHEEAKKRGLGGRLLAYVY

SEQ ID NO: 67637 - protein, 338 aa, Cryptococcus neoformans var. neoformans JEC21
MSVPCISLHDFDERRDEVIKELMDASMNVGFFTLCNHGISPEDVQAAFDLSRRFFALPDEIKIKTPLNGRNAGWEKNTQVRPSTGTADQKESMQLQFARMEGLWPSDEDVPGFRTRAEKFMNQIQALSIKVMECFADGLGLPHDIFTENTVERGENDCQNVLRLLHYHSIEDKQFGPNFWRAGAHADFDILTMLFQRDGEGGLEVCPGRKVVGDFGMGQTWIPVEARQDRIVCNIGDQLMRWSDDQLKSTYHRVRLPEGNESKGPRYSIAFFNQSRINTVIQGPQKKYPPITGGKFIAEAMAKNRMQSADIARRVALETGENFATEVHFVPKHLQVVA

SEQ ID NO: 67638 - protein, 238 aa, Glycine max
  misc_feature (80)..(80): Xaa can be any naturally occurring amino acid
SARALTSSSSTFIPKRYSFFFFLSILFALRSSSGGCSEYHHHHAPMATIGGLRDSQGSQNSVQTEALARFAVDEHNKKQXVRTQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 67639 - protein, 379 aa, Streptococcus mutans
MKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 67640 - protein, 331 aa, Ostreococcus tauri
MSEADGIYVETVRDMYESWVVYNFLNLCLEYVGGPGAIVNAMTGKEVKAGSWLRGTCVYDRDLVVDGHYIRRCKQGCLQFVFIKPLLSVLEIVLQAKGKLGDGQINFLKAYVYILFVYNISYSLALYALWMFYLGAHDPLAKYNPLLKFIIVKSVIFFSFWQSVFTAMAVRTGTLESPLEGRAVQNVLICVEMFIVSFLMWFAFPYKDFVDPEGVKRGFVSNVVNFVSVRDVFDDTVHQFGATYQEYTLHGDGETPDRTVRMRTFVPTGRSSAPAEDERDTASLSANMAMENAFFHDEERANGPVGLDRSDAPRSPGRPVELVSIEEGQRL

SEQ ID NO: 67641 - protein, 176 aa, Burkholderia vietnamiensis G4
MSSRRIAVRRSGIHGKGVFAVEPIKAGERVVEYKGERISWKEALRRHPHDPNDPNHTFYFALEDGGVIDGKVNGNSARWINHSCTPNCEAEEIKGRVFVHALRDIEPEEELFYDYGLVIDEKLTKKLKREYACHCGAETCRGTLLATPDDDGKKKKKKDKKDGKAESGAKDKKKKK

SEQ ID NO: 67642 - protein, 242 aa, Vibrio vulnificus YJ016
MSAHHLPIFVLLCHNVSNNTYLVKAVLMKFNAAIFDMDGLLLDTERVCMRIFKQACDVQKLPFYQETYLSIIGRNSAGIDAILRAAYGDDLDRLHAEWRKRYNQVVLHEAIPVKEGVIALLEWLKSHQIPAAVATSTQKDVALVKLKLAGLDHYFESITTGCEVTHGKPDPEIYLLAASRLNVPPAQCLAFEDSNNGVRAAVAANMMTYQIPDLVEPCEEVIAFGHRICPSLTEVLKELQPD

SEQ ID NO: 67643 - protein, 259 aa, Tropaeolum majus
MASAREESVYMAKLAEQAERYEEMVEFMEKVSASAEGEELTVEERNLLSVAYKNVIGARRASWRTISSIEQKEEGRGNEDHVTVIRDYRSKIESELSNICDGILKLLDTRLIPSASSGDSKVFYLKMKGDYHRYLAEFKTGAERKEAAESTLTAYKAAQDIANSELAPTHPIRLGLALNFSVFYYEILNSPDRACNLAKQAFDEAIAELDTLGEESYKDSTLIMQLLRDNLTLWTSDMQDDGADEIKEAAAPKPAEEQQ

SEQ ID NO: 67644 - protein, 495 aa, Geobacter metallireducens GS-15
MFTFLTAAHAGSINDQSAFIERRGAGMKKVIVVGGGISGLATAFELRNKGAEAGIELDVTLLEKEERVGGKIWSIKEEGYLCEWGPNGFLDSKPQTLDLCRDLGASERLLRSNDNARKRFIYTGGVLNRLPENGPTFLKSSLISWPGKLRLAMEPFISKRTDGTDETLASFGRRRLGEEALQKLISPMVSGIFAGDPETMSLRSCFPRIAELEDEYGSLIKAMIKLAKKKKQEAAQGKAVSSAAGPGGVLTSFRWGIQELTDILAEQLGSATVVTGQPVTGLTRGSSVPWRLKTPTVDIDADVVILASPAHATAGIVSGVDAAMAQVLGEIPYASMTVVCFGFERERIAYDLNGFGYLIPKDEGMNTLGTLWDSSIFENRAPEGKVLLRSMLGGACFPEYVKLSDAEVMQRVKADLKATMGITADPSFIRIFRHPQAIPQYTVGHGKRLAALQERSSALPGLFLTGNSYRGIGLNDCATAANRTTDEVVAYLKGR

SEQ ID NO: 67645 - protein, 559 aa, Bacillus cereus ATCC 14579
MDDVVTESRNPISKFFAKIGRQKRYMRVSSIAIKHGMGKYLALKRSPEADRKLATSLRNTLEECGGVFIKFGQVLSTRSDLLPPVFIHELSNLQENVTRLSQKQVEEILKKELHTPKDEIFSSFEMEPLAAASIGQVHKAKLKENDQDVVVKLLRPNISETIKRDLDILIHFSLWISNKSTWAKNIGFLDLAHGFSIAMKEEIDFKIEARNFEQVSDSLKNSETKVKIPKVYKKYSNSKILVLEFLDGVSVKSGSALLNELQIDTKKVQRQLFDCILEQIFFKGIFHADPHPGNVYILRDGTPALLDFGSVGRLGTLQQDAFKRLLIGFERKNSYVLLDGLLQLVEKKPNVDKEGLEQSISQLLIQSTYGSTNGSEEFIQGLFQIIAEFELAFYPMVAGAFRSLITLEGTMLQLNPEFNLMDEAKRFAKDHAASFMPVNNYSSLKEAATNELLAMLPAMRRIPRKLDDLSSKLENGELSVKVGFFSDETNASFITTFISQFLIAFIGTAFGGISVGVLHLANSATEPNDQFLSVVGYGGLFISAILLVRVAIHAVRKFK

SEQ ID NO: 67646 - protein, 311 aa, Oryza sativa
CAVYMHCEGCARKVRKILKGFDGVEDVIADSKAHKVLVKGKKAAADPMKVVERVQKKTGRKVELLSPMPPPPEEKKEEEKKEEPEPPKPEEKKEPPVIAVVLKVHMHCEACAQGIRKRILKMKGVQSAEPDLKASEVTVKGVFEEAKLAEYVHKRTGKHAAIIKSEPVAPPEKVAAEGGDEKKAAEGGDEKKDEKEEKKDGKEEGGNGGGDEKKEEKEKEKEGGNADGEEKDKDKEKDPAAIAAANLYLHYPRFAFPAGYYPPGPGYAYPPPYPPSYPPPYQPSYPPYPSHPSHHPSQIFSDENPNACSVM

SEQ ID NO: 67647 - protein, 399 aa, Glycine max
  misc_feature (115)..(115): Xaa can be any naturally occurring amino acid
MEDPEVIIGSLNPNDTRGKTVTCKAAVAYGPGEPFVVERVLVHPPQKMEVRIKILFTSICHTDLSAWQGENEAQRAYPRIFGHEASGIVESVGEGVNDMKEGDLVVPIFNGECGXCKYCKCEKTNMCERFGVDPMKKVMASDGATRFSTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERPVYEIIGEMTGGGVHYSFECAGNLNVLRDAFLSAHEGWGLTVLVGIHLSPKMLPIHPMELFHGRRIVGSNFGGIKGKTQLPHFAKECMNGVVKLDDFITHELPFKEINQAFDLLTPGKSLRCLLHF

SEQ ID NO: 67648 - protein, 317 aa, Mycobacterium sp. MCS
MSLHALVIGEALIDIVERDGVVQGEHVGGSPLNVAVGLSRLGRGVDFLTHIADDARGRRIVEHLEAAGVHLVAGSRNAARTPTARAMLDDKGSARYEFDIDWNLTGTPEAAPPLVAHTGSIATVLEPGCRATAALLDAYHLSATITFDPNIRPALIDDADAARARIDRLVERADVIKASDEDLRWLDPNRTPKQIARAWLQLGPSIVAVTEGGQGAFAVCAAGSARVAALPVEVVDTVGAGDAFMSGLIDALWTHGLLGAEKRRELRAIRLDALHDVLQTAALSSALTVTRAGADLPDRATRDAAAREPATLIDRRR

SEQ ID NO: 67649 - protein, 457 aa, Mannheimia succiniciproducens MBEL55E
MKTLCKSSTRFDKQALSLGFSELILQENAARGVAELVRQKLQTGEKILFLCGGGNNGSDAIACARMLSGDYECELYFITENLNANAQAQLNIALKVGVNRVSQPDLANIGCVIDGMFGSGLSRDLDAEIIRLLDRINAHNALKIAIDFPSGLDGNGNIRGACFKTDFTLAMGALKIGLFSDVAKDMTGEVSLVNLGLSDNRFITNQEDFLLERTDLNLPSRTLQNVHKGSFGHAFVALGQMPGAGIMAATAALIMGAGKVSVVGKAENLTPQIMQKNNFDGAGAVAIGIGLGNADIDISAIKHLPCVLDADLCYRAEIREFLPNPSAVFTPHPKEFSGLLRNLGLADISIEEAIKNRFELAREFSRQIKGVLLLKGANPIIAYNGTLYLCNLGSNKLSVGGSGDVLAGIILGYLAQGFTALEAAQNAVLAHAKSAENYQGNDYSMTPLDLIDGLRYL

SEQ ID NO: 67650 - protein, 110 aa, Mannheimia succiniciproducens MBEL55E
METLDKIKKQIAENPILIYMKGSPKLPACGFSARAVEALINCQVPFGYVDILQHADVRAELPKYANWPTFPQLWVEGELIGGCDILLEMYQAGELQTLLKEVAERHKEQV

SEQ ID NO: 67651 - protein, 476 aa, Glycine max
MKKENSVMLKAGELPGRLTRARAAAALRAYGQLPPLKERAQQNQNQLSRVNSKRAVSDNTCLQRKRKAVLQEVTNVCRENAYKGCFNSTKIQAKKSKLAKAGQINVSKVAPSVTVEPRQFQVDSKAKETALQSEDTMCSINLENNEFLRLSANDCSKDFRLPESQMSGISAHPLISQKKDKKDNLPKLLTALKDPDITNIDDDDLEDPQSCSLYAADIYDTMRVAELARRPHPNFMETVQRDITQSMRGILVDWLVEVSEEYKLVTDTLYLTVYLIDWFLSKNYIERQRLQLLGITCMLIASKYEEINAPRIEDFCFITDNTYTKAEVLKMESQVLKSSEYQLYTPTIQTFLRRFLRAAQASYKDQSLELECLANYLAELTLMDYGFLKFLPSIIAASAVFLARWTLDQSNHPWNPSFQHYACYGASDLKTTVLALQDLQLNTDGCPLTAVRTKYRQDKFKCVAALSSPKLLETLF

SEQ ID NO: 67652 - protein, 512 aa, Arabidopsis thaliana
MSATLKNPVIKLKLLIDEEKNKVVFVEAGKDFVDLLFSFFTLPMGTIVRLLEMYKKSQKIAIGCFSNIYASVVSMGIEHFLTEACKQMLLYPGSLNHEKCRNLKLRVDDSEATKYFVCPKFVEREQCTESYSNFNTSRCSCGVLMNEVTQLDGRGGLASAGNGVEGGVFVRSDHTSFMITDDLKVEITSVRLTLNVLKDLGYVDCEKLDEKIHDVNLEEVPTLLECLSTSDNPLTDTFLKKKSSYSTKRIQKLPSPGLCEDREESTPDQTITLNVVKKEGNILFVECGDDFVDLLFTFLAIPLESAWGIAGDGIIIGCIGNLSKSFKDLSVDPGREAKCVLPHYYKCQKQLLDAVTTHKPPTFYLYVSSMASNHIREYRLSEDSSKPLVYFWDELMPMISIDPKSKGSTNTTDESTIPSGGFMKRGTKFMITDDLIITPLNSTSTIGLVKEKQIRLDDVEVQEIIIRKEEAIRLLQASLVTCSALSTGLLAIESASTSVPQSANLKKPKIET

SEQ ID NO: 67653 - protein, 518 aa, Medicago truncatula
MAGGGIPIGGGNKEYPGNLTPFVTITCIVAAMGGLIFGYDIGISGGVTSMDPFLKKFFPAVYRKKNKDKSTNQYCQYDSQTLTMFTSSLYLAALLSSLVASTITRRFGRKLSMLFGGLLFLVGALINGFANHVWMLIVGRILLGFGIGFANQAVPLYLSEMAPYKYRGALNIGFQLSITIGILVANVLNYFFAKIKGGWGWRLSLGGAMVPALIITIGSLVLPDTPNSMIERGDRDGAKAQLKRIRGIEDVDEEFNDLVAASEASMQVENPWRNLLQRKYRPQLTMAVLIPFFQQFTGINVIMFYAPVLFNSIGFKDDASLMSAVITGVVNVVATCVSIYGVDKWGRRALFLEGGAQMLICQVAVAAAIGAKFGTSGNPGNLPEWYAIVVVLFICIYVAGFAWSWGPLGWLVPSEIFPLEIRSAAQSVNVSVNMLFTFLVAQVFLIMLCHMKFGLFLFFAFFVLVMSIYVFFLLPETKGIPIEEMDRVWKSHPFWSRFVEHGDHGNGVEMGKGAPKNV

SEQ ID NO: 67654 - protein, 850 aa, Zea mays
MQMPFCPSLNLWDRSPAHAPENHIAIDGTVVVSCHFGLSLPGKTTTLRLFSSTQMDPNTGKGKLSAEAPLRGGKKTKQQGRKTSTMAYQVTFFVDAEFGTPGAVVVKNGLRNDQFFLRHVQLNLPEDGRSVHFECNSWVYPYKKTNADRVFFINTSYLPDRTPQALRLLRDEELRSLRGNGRGERKDWERVYDYDLYNDLGDPDKEDRARPALGGTATHPYPRRCRTGRPLFKTDGVTETRKHLINLDFYIPPDERFSPTKLAEVLALAVQAVTHFVVPESNALFHGNVNSFRSFDQLKDDLYGRRPPVAVDGQVMDKLKTSVPSHKTYKQVSKMVKETPVKFPIPQVIEHDQEAWRSDEEFAREMLAGLNPVVISRLEVFPPVSRGGKKSSITEAHIESQLQGRTVQKALDDKRLYLLDHHDYLMPYLRRINTQQGVCVYASRTLLFLRDDGALKPLAIELSLPGDGAEVSSRVILPATPGTTDGHLWWLAKAHVSVNDSGYHQLISHWLFTHATVEPFIIATKRQMSAMHPIHKLLEPHFKDNMQINTLARSILLSAGGILERTMYPGKYAMEMSSAIYSEWRFTEQSLPNELVKRGMASKMGGGAIALHVEDYPYAVDGMDVWRAIEGWVRTYCAHFYHSDAAVAADAELQAWWDDVRRVGHGDRQRDPACWLDLDSVANLAESLSTLIWIASALHAAVNFGQYGYAGYMPNRPTRCRRFVPLPDSPEMAQLEADPDRFFLDTVPDRFTATLGLTLIEVLSNHTSDELYLGQRATAAWTDDGEVLQLLDRFREELRRVEKRITERNRDPRLKNRKGPAKVPYTLLFPDVGGKEKGITGKGIPNSVSI

SEQ ID NO: 67655 - protein, 214 aa, Gracilaria lemaneiformis
MARSDDEYDYLFKVVLIGDAGVGKSNLLSRFTRNEFSLESKSTIGAEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSTVEEAFRSILSEIYRLGSKKALEKGSTSNFAPNATQTIVINPPADEGKTEKAKCC

SEQ ID NO: 67656 - protein, 488 aa, Arabidopsis thaliana
MKMMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 67657 - protein, 214 aa, Gracilaria lemaneiformis
MARSDDEYDYLFKVVLIGDAGVGKSNLLSRFTRNEFSLESKSTIGVEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSNVEEAFRSILSEIYRLGSKKALEKGSTSNFAPNATQTIVINPPADEGKTEKAKCC

SEQ ID NO: 67658 - protein, 253 aa, Pteris vittata
MARKFFVGGNWKCNGTVAEVNKIVKLLNEADVPSEDVVEVVISPPFVFLPQVKAVLRSDFAVAAQNAWVRKGGAYTGEISAEMLINLEIPWVILGHSERRALLKESNEFVADKVAYALSQGLKVIACIGETLEQREAGETLNVVSEQTKAIAEKIKDWSNVVLAYEPVWAIGTGKVATPVQAQEVHADLRSWLATNVSSDVAESVRIIYGGSVNAGNCVELAGQPDVDGFLVGGASLKAEFVDIIRSALVSKS

SEQ ID NO: 67659 - protein, 550 aa, Oryza sativa
  misc_feature (14)..(14): Xaa can be any naturally occurring amino acid
  misc_feature (30)..(30): Xaa can be any naturally occurring amino acid
  misc_feature (40)..(40): Xaa can be any naturally occurring amino acid
  misc_feature (66)..(66): Xaa can be any naturally occurring amino acid
MSAAHLLRHSRKLXRSLHNALDCERSGPRXRYFSTASGSXFPTKGNVLLVSTGAEKRIGGARFPQXKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSEPTEPKVEEREPSKASELKAPRTEEPSRSGDRIFSSPLARKLAEDNNVPLSSVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 67660 - protein, 266 aa, Glycine max
PPSSEFLSLTTTTPFFTSSHSPFHRVLIMLGKRPRPMIGKLSELLVSRGRTVAYLDTTGSPRGPLDMKMMQSSPRGLKNYDLGGVGLGIVVALDKSNEVAAREVLPKHAVCTSNLNRSGPIPVHYTKNPDEFDVEEYTYVTCHVPNKTFTKVYYDGGEGEIRRHYNNSNVGVLRRTAPQPLIVEAESLYPTSNFLSSCHLCGKKLHGKDIYMYRGEKAFCSPECRSSQIMMDERKERCRSEASRSVEMSSSPYAREQIFSTGILAL

SEQ ID NO: 67661 - protein, 496 aa, Magnaporthe grisea 70-15
MSLVTELKTPVTGAYQQPTGVFINNEWVEGVDKKTFETINPSTEEVICSVSEATEKDVDIAVKAARKAFEGEWKQTAPGQRSKLLTNLAELVEKNLDLLAAVESLDNGKSLAMAKGDVGAVAGCLRYYGGWADKIEGKTIDIAPDMFHYTRSEPIGVCGQIIPWNFPLLMLAWKLGPALATGNTIVLKTAEQTPLSALVFANLIKEAGFPAGVVNIISGFGKVAGAAISAHMDIDKVAFTGSTVVGRTIMKAAASSNLKKVTLELGGKSPNIIFNDADIEAAVSWVNFGIYYNHGQCCCAGSRIYVQEGVYDKFVAAFKERAEKNKVGDPFKEDTFQGPQVSELQFNRIMEYIKSGKEEGATVETGGERHGDKGYFIQPTIFSNVRPEMKIMKEEIFGPVVAMAKFKTEEEVIALANDTNYGLAAAVHTKDLNTSIRVSNALKAGTVWVNCYNMLHHQLPFGGFKESGIGRELGEAALANYTQNKSVAIRLGGPIF

SEQ ID NO: 67662 - protein, 493 aa, Arabidopsis thaliana
MVSSVSLFASLTPYLVSALLLFLLLEQLFYRVKKRNLPGPLFVFPIIGNVVALIRDPTSFWDKQSAMADTSVGLSVNYLIGKFIIYIKDAELSNKVLSNIRPDAFQLTGHPFGKKLFGDHSLIFMFGEDHKSVRRQVAPNFTRKPLSAYSSLQQIVILRHLRQWEESFSSGSRPVSMRQLIRELNLETSQTVFVGPYLDKEVKKTICDDYSLLTLGTMAIPIDLPGFTFGEARQAVSRLVNTMSVCVGKSKAKMAAGENPTCLVDFWTHSIIEENPPPPHSKDKEISCVLVDFMFASQDASTSSLLWAVVMLESEPEVLRRVREDVARFWSSESNELITADQLAEMKYTRAVAREVLRYRPPASMIPHVAVSDFRLTESYTIPKGTIVFPSLFDASFQGFTEPDRFDPDRFSETRQEDEVFKRNFLTFGNGSHQCVGQRYAMNHLVLFIAMFSSMFDFKRVRSDGCDDIVHIPTMSPKDGCTVFLSSRLVTSP

SEQ ID NO: 67663 - protein, 355 aa, Arabidopsis thaliana
MADEKENCVRMTRAATKRKASMEAAIDKERINKKRVVLGELPNLSNIKKSRKATTKQKKKSVSIPTIETLNSDIDTRSDDPQMCGPYVTSIFEYLRQLEVKSRPLVDYIEKIQKDVTSNMRGVLVDWLVEVAEEYKLLSDTLYLAVSYIDRFLSLKTVNKQRLQLLGVTSMLIASKYEEITPPNVDDFCYITDNTYTKQEIVKMEADILLALQFELGNPTSNTFLRRFTRVAQEDFEMSHLQMEFLCSYLSELSMLDYQSVKFLPSTVAASAVFLARFIIRPKQHPWNVMLEEYTRYKAGDLKECVAMIHDLYLSRKCGALEAIREKYKQHKFKCVATMPVSPELPLTVFEDVNI

SEQ ID NO: 67664 - protein, 276 aa, Hevea brasiliensis
DKIVVDKPIYVKALMSKTAGSIVGAALRRDPHEAEFIQSVQEAVHGLERVIAKNTHYVNIMERLLEPERMLLFRVPWVDDRGETHVNRGFRVHFNQALGPCRGGIRFHPSMNLSIAKFLGFEQTLKNALSPYKLGGAAGGSDFDPKGKSDNEIMRFCQSFMNEIYRYLGPDKDLPAEEMGVGTREMGYLFGQYRRLVGHFQGSFTGPRIFWSGSSLRTEATGYGLVFFAQLMLADMNKELKGLRCVVSGSGKIAMHVLEKLIAYGAVPVTVSDSKG

SEQ ID NO: 67665 - protein, 408 aa, Mycobacterium sp. MCS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISSLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 67666 - protein, 307 aa, Oryza sativa
  misc_feature (123)..(123): Xaa can be any naturally occurring amino acid
MAETLDMTLDDIIKNNKKANPSSGRGRRGSAAGGGGGGGGGVGGGGGGGVGPTRRPFKRSGNRAGPYQPPKAPESAWQHDMYSDVAAGGGGGSGGGGRVSAIETGTKLYISNLDFGVSTEDIXGDLKKYVIHYDRSGRSKGTAEVVFARRGHAVAAVKKYINVQLAGKPKKIEILGTNTPTVAAALPANNGGYVRNVPKTCTKGWPSCTPPQVALVQGGLGAPVAGGGGNGGPGVSGVPQGNEVSPTPPPPPPPTPPPPPPPPPAADPRRPRPDEGLAFLLFLMMSSSVMSRVSAMAAARGRVDLAR

SEQ ID NO: 67667 - protein, 457 aa, Mycobacterium sp. MCS
MSSTTPLNPSVGEGEGQLRRVLGVPSLVLFGLVYMVPLTVFTTYGIVTVESGGRVPLAYVVTLAAMIFTARSYARMAAAYPVAGSAYAYTQKTFGAPVGFLAGWSLLLDYLFLPMLNYLVIGLYLNAAVPAIPQWLIVVVTIAIVTVLNIIGIVSVARANLLIIAIQAIFIVVFIVMAVAAVSGSGSVDVMAPFRGDGTADGMAPVLAGAAILCLSFLGFDAVSTLSEEARDARRDVPKAIMLATIICGVLFIILSYVSQLVFPSNAFTDVDSGSLDVMQSAGGAFLAAFFTAAYVAGASGSALTSQASVARILYAMGRDGVLPRKVFGHVSVKFGTPTWAVLVISIVSLLALVIDLAILASVVSFGALVAFSAVNLTVIKHYFVDAGEKNVVNNLVLPLIGFVLTVWLWTSLSAESLTIGLIWLAIGFLWLLGVTRGFRRPTPVLDLEELPAQPAK

SEQ ID NO: 67668 - protein, 424 aa, Pseudomonas fluorescens PfO-1
MQQEFNDPLWRTVLSGAQMLFVAFGALVLMPLITGLDPNVALFTAGLGTILFQIVTGRQVPVFLASSFAFITPIILAKGQFGLAATMGGVMAAGFVYTFLGLAVKIKGTGFIDRLLPPVVIGPVIISIGLAMAPIAANMAMGKAGDGSELIHYQTAMMISMPALLTTLIVAVFGKGIFRLVPIISGVLVGFAMSFYFGVVDTAKIAAAPWFALPHFTAPEFNWQAILFIVPVALAPAIEHIGGVIAVGSVTGRDYLKKPGLHRTLLGDGIATTAAGLFGGPPNTTYAEVTGAVMLTKNYNPKIMTWAAIFAISLAFIGKFGALLQSIPVPVMGGILCLLFGSIAAVGMNTLIRHKIDLGEARNLVIVSVTLVFGIGGVLVGTGTGPDDFGLKGIALCAVVAIALNLLLPGNDSWKQKKADEPLI

SEQ ID NO: 67669 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 67670 - protein, 148 aa, Oceanobacillus iheyensis HTE831
MEKTFLMVKPDGVQRELIGEIVKRFETKGYKLAGAKLMQVSNQLAETHYSEHKERPFFGELVDFITSGPVFAMVWEGENVIATARKMMGKTNPLEADPSTIRGDFGISVGKNIIHGSDSAESAEREITLFFTENEIVSYEKQANNWIY

SEQ ID NO: 67671 - protein, 323 aa, Oceanobacillus iheyensis HTE831
MKLPKIYGFLKKDMESIESALQDSIQANHPVLRDASTELLHAGGKRIRPVFVLLSSQLGNYDLSKIKKVAVTLELIHMATLVHDDVIDEAELRRGKPTTASIYGNRVAMYTGDYILARALEEITEIPDPRVHQLLSKTLVEVSIGEIEQIEYKFNWEQNFRDYLRRIKRKTALLIASSCKLGAIVGGLNDYQTNKLYQYGYYIGMSYQIIDDILDFTSTSKELGKPAGNDLLQGNITLPVLYAMEDKTFKQSLFNVFSKDGHVTTNEMKTLIQHLKRTDAIKRSYAVSDMYLSKALTALDEIPASRAKKTLQDIATYIGKRRS

SEQ ID NO: 67672 - protein, 340 aa, Oryza sativa (indica cultivar-group)
MAAAAPALPAFASLLLPSSSSPPRRIPWPRPLPSRRGALRPVKLLPAISAVEKGKGAAAEAKEVELEGMPPEYYDEEWQARQREKTKEWNAYRKKEEAEEERLTNEYREIGMRLKAYPQEEVRKARILVSSFIRAGEDIEEEIEKAAERGELTELVLMVIWNRLDVARRDRKIIIVECAENAFEKHDERDAIRSLDLLYRRVETEILRSEATPAMRLLNDLLNLHDGSDDDKWLKKCKKHMLEVFPREDPFTMVFPAGFNMEEHQGQIKLPPQDDDVLLRVDFIREVDELLKEVQAAHENNKVPTGNDPEAVATKLKYQEKLRTIRQVESLLELASSLKW

SEQ ID NO: 67673 - protein, 543 aa, Magnaporthe grisea 70-15
MSSTTEQAAAPHQTYDTILTLDFGSQYTHLITRRLRECNVYSEMLPCTTKLSDLTWKPKGIILSGGPYSVYDKDAPHADPAFFDLGVPVLGICYGLQELAWRLGKDNVVAGTEREYGHADLTPQKNSQAEKLFKGMGDDSLQVWMSHGDKLSQLPTGFQTIATTANSPFAAIAHESQNIFGVQFHPEVTHTRRGLDLLRNFAVGICGAQQNWNMHNFIEQEISRIRNLIGDKAQVIGAVSGGVDSTVAAKLMKEAIGDRFHAVLVDQGVMRHNECAEVKKALQDHLGINLTVADASERFLSGLKGVEDPEQKRKFIGNTFIDIFEEEAIKIEKAAENTPNAGKVEWFLQGTLYPDVIESISFKGPSATIKTHHNVGGLPKRMMEGQGLRLIEPLRELFKDEVRAMGRELKINEELVMRHPFPGPGIAIRILGEVTRERVEIARKADHVFISMIKEAGIYNEISQAYAALDTSRAVGVMGDKREYGYIVILRAVVTTDFMTATVYHMKPELLDRISTRIVNEVDGVTCVTYNITSKPPGTIEMQ

SEQ ID NO: 67674 - protein, 391 aa, Shewanella oneidensis MR-1
MSQFQSIDVADYYDAQTFKRIEEFAKDKATPFVVIDTSIIAKQYDDMVNSFPYADVYYAVKANPAAEILTLLKDKGSNFDIASIYELDMVMNVGVTADRVSYGNTIKKRQDVRAFYERGVRMYASDSEADLRMIAEEAPGSRIYVRILTEGTDTADWPLSRKFGCQNEMAYELLVLANELGLEPYGISFHVGSQQRDIGAWDSAIGKVKSIFDRLRDEHNIVLKMINMGGGFPANYIDKTNQLGVYAEQITHFLKEDFGDDLPQIILEPGRSLISNAGVLVSEVVLISKKSYTALERWVFTDVGKFSGLIETMDEAIKFPIFTHKQGELEKCVIAGPTCDSADIMYEHYSYGLPNDLAIGDRMYWLTAGAYTTTYSAVCFNGFPPLKDYYL

SEQ ID NO: 67675 - protein, 216 aa, Festuca arundinacea
MDAAVAVSLSLQSEEQEYRTVWSEPPKPRSERTKFQEARHPVYRGVRRRGRAGQWVCEMRIHGTKGSRLWLGTFDTAEMAARAHDAAALALSGGDACLNFADSAWRMQPVLPAGAESVCFGGAQEVKDAVAAAVEAFQEEEHHVASTAETAKDKESALSMSSDLSEHDDERWIDGMDAGSYYASLAQGMLVEPPDAGAWREDGEHGGVETSLWSYL

SEQ ID NO: 67676 - protein, 536 aa, Magnaporthe grisea 70-15
MASNPDPGVLSPQEAIHASTQATSTVAASTVAASTQAPSPDLPISQPQPQPQQPSPPLPTSPSQLEQAHAFAEPEVPPPLLPTPKSATFARSTQGGSSRRRRRSRSRNRAGTATSANNPYFPGDQASTRRLRYSIDEYEDEGLRNEIGRHPDGRSMPRARPPRAYLNHPAYANLDSPAKPYTEDPKGHREFDYEVDPNTRQQYEEEYAYGTGVSHGPGMAGPQPFMRFGPTSNASHYGPDSQAPRINWKDLSREERTEVLRLPWTQWMNSNVKNHFVAMLGELIGTTMFLFFAFAGVEVANIGLPSSAPFNLAKQLYISLSFGFSLMVNVWIFFRISGAQFNPAVTLALWMTGAVDAVRGVCLVISQLCGGMLASVIVRFLFPQRFSVRTSLSQNTSLVQGVFIEALLTSELVFTILMLAKEKHKATYMAPVGIGLALWIDHMVGVPFTGAGINPARSFGPCVVTATFEPEHWIYWVGPGIGALIAVAFYKLIKVLEYEMANPGADGDADNDPTQNPAKRAELAAGRRFAGGFDAK

SEQ ID NO: 67677 - protein, 335 aa, Triticum aestivum
  misc_feature (63)..(63): Xaa can be any naturally occurring amino acid
MANLLSSAPTHATLPDCFVFPPDQRPPASSQAVSLPVIDLSRGRDEVRRAVLDAGKELGFFQXVVNHGVSPEAIRDMEAVCAEFFRLPAEDKVGFYSEDTDKPNRLFSSTTYELGGEKYWRDCLRLSCGSPVGDTKNNWPDKPQKLREVVEKFVGPTRGVGMELLRLLCEGMGLRPDYFEGDLTGGDVIINVNHYPPCPAPGLTLGLPPHCDRNLITFLLQSTVPGLQVSYKGDWINVESAVPNAFVVNFGHLLEIATNGVLKSIEHRAMTNAALARTSVATFIMPAADIPIGPAEELLGEGNPPRYRTVTFDEFMRVYKTVGARRESVEKAFKL

SEQ ID NO: 67678 - protein, 474 aa, Salmonella choleraesuis
MQYQLLINGVLVDGEGERQSVYNPATGEVILEIAEASPAQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAAAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 67679 - protein, 179 aa, Gluconobacter oxydans 621H
MSFQDPQPLDLKNYIREIPDFPKRGILFYDISTLIRSPDAWQVATARLARVIAAWQPDILAGIESRGFLTAAPLALRLGCGFTMLRKPGKLPGKTISLKYGLEYGEDELHIQADAIKPGQRVVVLDDLLATGGTLAASIDLLRKVGAEVVGASVLIELADLKGREKLDVPLNALMTYDE

SEQ ID NO: 67680 - protein, 497 aa, Spinacia oleracea
MSTVGRFMATMSNSLSLKHGVSLYSSTSSSFSLSKLHCKPSLVASRPFYNRRCFSISASSSFANDNREYVIVGGGNAAGYAARTFVEHGLADGKLCIVTKEAYAPYERPALTKGYLFPLDKKPARLPGFHTCVGGGGERQTPEWYQEKGIEMIYEDAVTGVDIEKHTLQTQSGKSLKYGSLIVATGCTATRFPEKIGGNLPGVHYVRDVADADSLIESLKKAKKVVIVGGGYIGMEVAAAAVGWNLDTTVIFPEDHLLQRLFTPSLARKYEELYEQNGVKFVKGAMIKNLEAGSDGSVAAVNLENGSTIEADTIIIGIGAKPAVGPFENVGLDTTVGGIEVDGLFRSKVPGIFAIGDVAAFPLKMYDRVARVEHVDHARKSAQHCVSALLSARTHTYDYLPYFYSRVFEYEGSQRKVWWQFFGDNVGEAVEVGNFDPKIATFWIDSGRLKGVLVESGSPEEFQLLPKIAKAQPLVDKAKLQSASSVEEALEIIHQSM

SEQ ID NO: 67681 - protein, 482 aa, Staphylococcus aureus subsp. aureus MRSA252
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSIAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAVTFVLVLLVFWGLGFEAKLYTLIWFIVGIILYLSYGLRHSKKNDVAEYHPPK

SEQ ID NO: 67682 - protein, 320 aa, Sulfitobacter sp. EE-36
MTTPFLDTARRVIRTEAQALEQLADSLDDRFRQAIDLLVATRGRVIVTGIGKSGHIAKKIAATLASTGTPAQFVHPAEASHGDLGMITGDDVVLAISNSGEAPELANLIAYSRRFSIPLIGITSRAQSSLGAQCDVVLELPQLAEACGTGVVPSTSTTMTLAMGDAVAIALMENRAFTAEHFREFHPGGKLGARLSRVADLMHTGDALPLVQVDAPMSDALMAMSSKSFGVVIVTDSNGALAGIITSGDLGRHLEGLMSKTAREVMTPTPVTVAPDALAEKAVGIMNARKITCLLVLDPAQGDVPAGLLHIHDCLRVGLG

SEQ ID NO: 67683 - protein, 752 aa, Cryptococcus neoformans var. neoformans JEC21
MFNSSRDNTTEQEKNDDEIYTTELKGDESPSSSSSDIDEKNEKFDPYVDQSQEGIAVEEAKLDDFIHRDEKYDWDSEEFRNIPELVRNTVSFEDDPSMPVITFRAILLSTIFCAIGSVISQISYFRTTTAQFPVFFVILASHPLGKLLARVLPDYTVPLGRFSFSLNPGPFSVKEHVIIGIAANTGSQGQWATYLPTNAALYYNITMSPAIALFFGWGVSLLGFSFAAMVRPILIDDPQFIFPLSMQQVAVYRSIQGTSELHLERSRKQMRVSSFRYLKVFWWLFLGMFAWQFLPEFAFPFVASLAPLCWFASRNHKVNFLGAGRGGAGLLNITLDWSNITSTVITYPYSVQVIIFVSFCWILIPIAYFGNLWGSPTWNIMSNGVFMKNGTSYPFNSLCNMKRSALHTLELSTCGMSLWAWRAKKPAHNDRLSRIAAKYPGLTWWEWGLLTLIPFVILLAVVVSKKLYMSTWTYFVALGFGAAAMLPMSLVYAMSGYSMKVGIFNELIYGCKSRSSRHPLGQLAYRIISGNVWYDARTVLEDQKIGHYFHLPPRQVIGIQILANMLALPINYAVMRWVLDTKFDYVSGKEVDPTGQWTGQEFQSYNSAGVQYSLVGPKRLFRSSVYRPLTYGFVVGAAAPVIIWLLHKRFPRARFNLWNTTIFFSGAATFYGNLSTGPFTAFIIGTVWNFWLYRYRRKFWNMWAYISGAALDTGFNFNLLFIFIFLGTTGAVMPYWWGNNADSIERCFALNE

SEQ ID NO: 67684 - protein, 310 aa, Mannheimia succiniciproducens MBEL55E
MHMTNKIWVLGDAVVDLIPDGDNHYLRCAGGAPANVAVGVARLGVPSAFIGRVGKDPLGEFMRDTLNQENVNTDYMLLDPKQRTSTVVVGLTDGERSFTFMVNPSADQFLQISDLPQFQAGDWLHCCSIALINEPTRSATFTAMKNIRAAGGKVSFDPNLRESLWKSQDEMIDVVMEAVSLADVLKFSEEELTLLTHTDSLEKSFEKITALYPDKLIIVTLGKEGALYHLHGKKEVVAGKALKPVDTTGAGDAFVSGLLAGLSQTENWQQPEQLVTIIRQANASGALATTAKGAMSALPNQQQLAEFLAN

SEQ ID NO: 67685 - protein, 549 aa, Arabidopsis thaliana
  misc_feature (132)..(132): Xaa can be any naturally occurring amino acid
MDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTVPNHFCSFFSICXFGTSNKVLSVSGVQPDRRKRSSEITKELYERMYEADANVSPFHPFRSRSPAPYNTHERGRDYSRERYEAEGNVTSRNRPSSPFHPSQSRSPPPHARLQTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 67686 - protein, 415 aa, Triticum aestivum
  misc_feature (174)..(174): Xaa can be any naturally occurring amino acid
RCVERDEEKRPCISEIINELNKIDNGIINEPDKNYSDIVDEQDKLNVHLVDEVDKIDGYIVDEQGKIDPDIVDKQDKLSTAKTSTTNLIPADRLDSLFTPRCVWVNGPIIIGAGPSGLAVAASLREHAVPFVMLEREDCIASLCRKRTYDSLKVNHPKQFCELPGMPLPDHFPXYLTRAHFMDYLQQYTTKFNIKPNFNNTVLSARFDETSGLWRVCARGAETDGNAKMEYISRWLVVATGAEAVVPDIPGLAGFCGEVTHSSDYSSGISYIGKRVLVVGSGQSGMEVSVDLCNGGAVPFMVVRNVLGIATLYLTVLLMWWLPLWLVDKIMALLAWIVFADLTRLGVRTPSVNSLTLKKTDDYGRAWRATARKIRSGEITVVTSVRRFTKSGAELSDDSVVDVDAVILATGYRSN

SEQ ID NO: 67687 - protein, 701 aa, Ostreococcus tauri
MKSYPKKRWEPELRDKRSKITRTGGFTNAQGLNIRWYSWEVKKPKCAIVFAHGLGVYGSFEMLASVPPGTPRVHYSTSWPERMNARDASLFCIDHQGHGRSDSAVKGKRCYFHRLDDLVNDFRQFCELLRDDLGGDVPVFVVGSSLGGFVATKTMMESPKAANGLVTLAPMLSLDALSNRPINRVLIPIGDVLSALVPTVPIVKTHRNVKFPLTQKEVEDDALTWPSGVRNTRVRVASEAYKNTLKLKKPGTLERITCPVLAFHGRDDPMTDPRSSSMLYERVSSADKRLQWVDGVFHDLCHEKPSSDEICDEIIEWCLARISGPILPKAAKRARESDRGAESDATPTRQSAVLDADVERAAVETRYRRIRKTVQMPTRSITLVSALIALACLPRSSSAVKFGEDFTDTLKKKPAPMEGRTYARDFEGTQIFADDLSTAYMHGLTCGACMAVLNETKRIYDEIIETKFHHPDDVTGGAMYDYMHEATEPDEFCDGNALWEKYAVNNITGHVASAAWLRLRAVSQLRLHGQFEGTEMGKRAMASLNEYRWAIDLGLLGYDLFSLIEPDEERFDPIKLAETNDVEVPEEDEEYLQKTDTREFIVRSLKTHPYRIARQKMKLEQVCHDIVKSRAYIQSMLHRGLIRDLHYEICHSTKKCMWKTPHEVRQIEQARKLAVDAYLEALVDEGADAFGDEDGDEEEEL

SEQ ID NO: 67688 - protein, 336 aa, Shewanella sp. MR-4
MSKRTITVIPGDGIGPSIIDSALKILDKAGCDFEYEFADAGLTALEKQGELLPQRTLELIEKNRITLKGPLTTPVGEGFTSINVTLRKKFGLYANVRPVLSFKGTQARYENIDIITVRENTEGMYSGHGQKVSEDGTTAEATSIVTRQGAEQIATFAYELARKENRKKVTIVHKANIMKSTSGLFLKVAREVSQRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKADMIRKAVSAVIEEGDRTTRDLGGTHGTTDFTQAVLDRLS

SEQ ID NO: 67689 - protein, 474 aa, Salmonella paratyphi
MQYQLLINGVLVDGEGERQSVYNPATGEVILEIAEASPAQIDAAVQAAVNTFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWGNDSRYGLASSVWTQDVGRAHRLSARLQYGCTWINTHFMLVSEMPHGGQKQSGYGKDMSLYGLEDYTLVRHIMVKH

SEQ ID NO: 67690 - protein, 474 aa, Salmonella typhi
MQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 67691 - protein, 474 aa, Salmonella typhimurium
MQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 67692 - protein, 252 aa, Salmonella enterica subsp. enterica serovar Typhi str. CT18
MKTVTVKNLIIGEGMPKIIVSLMGRDINSVKAEALAYREATFDILEWRVDHFMDIASTQSVLTAARVIRDAMPDIPLLFTFRSAKEGGEQTITTQHYLTLNRAAIDSGLVDMIDLELFTGDADVKATVDYAHAHNVYVVMSNHDFHQTPSAEEMVLRLRKMQALGADIPKIAVMPQSKHDVLTLLTATLEMQQHYADRPVITMSMAKEGVISRLAGEVFGSAATFGAVKQASAPGQIAVNDLRSVLMILHNA

SEQ ID NO: 67693 - protein, 503 aa, Ostreococcus tauri
MKRASSRLSRSLTAIARAPSARELAQRVELSVARASVASPSTRRSSATTLAWTRKAFFARSWSSDALPEHVIVPMPALSPTMTRGGIASWHVEVGQAIRAGDAIADVETDKATMAMEATEDGFMAAILVEAGAQDIEVGTPVCVTCENAEDVEAFKDYASTVAIKAESAAPVASAPSGPVESPSVAPVASAPSARATRAETRASGDRVFASPLAKRLAKERGVRLDNVRGTGPNGRVIAADVYEAHETGVNATEAAREVTVDHPLSKFFPDFEDVSVTAIKRVTAQRLTESKQQVPHFYLTVDVRLDNMISIRQTLNKQLADDKAAEGAKISVNDFIVKASAKALLAVPEVNSSWLGDKIRRYKKADISVAVQTERGLMVPIVRSACCLGLKTISSEVKALASRAREGSLTPQDMTGGTFTISNLGMFGVKSFAAIVNPPQAAILAVGGARKEVIKNESGGYEEITVMSATLSCDHRVVDGAVGAMWLQSFKGYIEDPMTMLL

SEQ ID NO: 67694 - protein, 801 aa, Bacillus cereus ATCC 14579
MKKRLVMIGNGMAGIRCMEEILKHDSDSYEITIFGDEPHPNYNRIMLSHVLQGKTNMQDIIMNEYSWYEENEITLYTNEKVQSINREEKIIITEKNRTLTYDKLIIATGSSAFILPVEGSTLPGVTGFRTIEDTQFMIDTANEKKKAVVIGGGLLGLEAARGLIDLGMDVHVVHLMPNLMEQQLDTKAASLLREDLEAQGMKFLMEKKTVKILGTDHVEGIQFEDGEVVDCDLIVMAVGIRPNTQIAKDAGLIVNRGIVVNDYMLTNDESIYAVGECAEHDGIAYGLVAPLYEQGAILAKHITNLQTDGYSGSIVGTQLKVAGCDLFSAGQIYEDDQTKAISIFDECKRSYKKVLIRDNKVVGIVLYGDTADGTRLFSMLKKEEDIQEYTPASLLHKAGEESEFDVATMSADDTICGCNGVTKGSIVHAILEQELTTFEEVKGCTKAAGSCGKCRPLVEQVLSHTLGDAFDASAQSAGMCGCTPLSRDEVVAAIHEKGLKSPKEVRNVLGFAHEDGCSKCRPALNYYLRMAIPEEYEDDKSSRFVNERMNGNIQHDGTFSVIPRMYGGVTTADDLMKIAEVAKKYDVPLVKITGASRIGLYGVKKQDLPNVWADLHMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLRIAAAYMQYYRETGIYGERTAYWTERLGFDHIKEILQDASMVTTLNERFQTARRTYTEAWGQALETKSLKAMYEVETVK

SEQ ID NO: 67695 - protein, 532 aa, Oryza sativa
MDVRRGGGGGRIVGAARRALTWGALPLPMRITNGLAMVSLVLSSCDLLRLCSDRERPLGGREFATVVYLVSLFAHPDAPATTTGDDDDGQGGSRRARPAAAEPAPMHGHGGGMMEADDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRGCRAISASGGAFSVLLRDAMSRAPAVKLPSAMRAAELKAFAEAPANFELLAAVFNMSSRFGRLQDIRCALAGRNLYMRFSCITGDAMGMNMVSKGVENVLGYLQNVFPDMDVISVSGNYCSDKKPTAVNWIEGRGKSVVCEAIIKGDVVQKVLKTTVEKLVELNIIKNLAGSAVAGALGGFNAHASNIVTALFIATGQDPAQNVESSQCITMLEEVNDGDDLHISVTMPSIEVGTIGGGTCLASQAACLNLLGVKGSNHGSPGANAKRLATIVAGSVLAGELSLLAALASGHLVKSHMMYNRSSKDVAKAAS

SEQ ID NO: 67696 - protein, 1039 aa, Magnaporthe grisea 70-15
MPRLRSKAYLTCFYCGRKTSTRNDGSVRRFECPSCEATNYLDENGEITDPPLEATAPSGATDDKPPTMRDLLASQPDNDVFCAECLKNQRLFTASLAQYLPGDPDDPEYEARERNFYKFRNNLDRQYPQTCSKCEPKVLERIAQAGYTAKTDHLRRMIDRSLKARTAEQASATGPLGVLSAVGRYLWLAGFIMQGLWHFRMMHELAKTADFPWLRSFGVRQLLGVLASLLSLLPEPEKVMKWSILSTAVSLWWNPFFLKTLTMHSLACIVMFYIAKLALSSIRVDTTPLFGSKSLPTPKSPEAAPQPSQRKSSGDTMFDMLDEVLVSPVPARESDDETETQSLPPKIRPRFTEGPLRGQQMSQGGGLFAPENARGSTFGRQDDKLRTTEYASEMDWQPTELPPRAFNPFSAPEQPLRSFNDAPVNDKHGPFWFKVPPAPATSMAHRALSPSTASSTALLQSQPEPIQQRRFFASREEEARKEQEVREERMRKEKERTKYIKSPSFRYRANDPRDPLSDMFEDTFKISPTRAASAQQAAQKADSAKEEVAARQIKASDFSVLLLSALLLIPGYETFVPKEYGVHMALSTLQVQGRHRSKAFAYTVAAALALSEVGFITWTGLKAQDSVFNLGNSADCLKLVKVADVKTLHVGTGTIFRVLGNPSLAFGWHSSEFCQGIESSQVVGYLCSSIWGLPGANLFTWYAWPAFQGLTSFFSCKWPNFGPIKNRSLENRRSARSSIEPGEQAKPDFESQTQSKRNSIMEIESTQELEDCVGSTTSIQSGCKLQKSLSMPALYASPYVWLDPMEPSSWGKDGYLKVMTGTGTAVKGTDFLQQLEAGLPGDSQKTSRPVNFGMIVPGVYRSGYPQQEHHAFMKDLKLKTVVTLVEKEPPEGFKPFLTSNNIKHHIIAMKGTKKESISLGTMQSILNVVLNPKNHPLLVHCNHGKHRTGCVAGVVRKVTGWETDAIIDEYRKFADPKERECDIDYITMFDIADAKLSSMFARKPLYAQVGPIGMVMLTILVLALFTLTMIKDNVATDWS

SEQ ID NO: 67697 - protein, 331 aa, Shewanella sp. MR-4
MISNQIHLASRPTGMPTQTNFKLVEVTLPALKTGEVLVKNTWMSVDPYMRGRMIDKDSYIPPYQINEVMDGGAIGEVIESLNPQFPVGAKVSHISGWRSAFISDGSDLTLLPAVNIPEQYFLGIIGMPGLTAWVGLMKVAKLKPTDTVFVSAASGAVGMVVCQIAKLNGCKVIASVGSDEKAELVKSLGVDAVINYKNVTDLTQALRDAAPEGIDVYFENVGGAHLEAALDVMNDYGRISVCGMIAYYNAQTPVPGPSNLLAINTKKLTMQGFIVMDYWDQYSEFVGQMAQWLQEGKMKSEETVYQGLEQAPDAFIGLFEGKNKGKMLVKL

SEQ ID NO: 67698 - protein, 212 aa, Marinobacter sp. ELB17
MTHCLRIGVGGPVGSGKTALLRQLCNALKDHYDIAVVTNDIYTREDADFLLKHDALPADRILGVETGGCPHTAIREDASMNLAAIDDLQNRHPNLELVLVESGGDNLSATFSPELSDLTLYVIDVSAGDKIPRKGGPGITKSDLLIINKIDIAEYVHASLDIMERDSKMMRGERPFVFANLYDGVGLETIISFILERGMLPERRPVKLAETA

SEQ ID NO: 67699 - protein, 117 aa, Marinobacter sp. ELB17
MYPREIKWCEECEECLSLVFFPKLELVLVESGGDKIPRKCGLSITKSDLLIINKIDIAEYVHASLNIMDCDSKMMRGEWPFVFANLYNGVGLEMIISFILERGMLPERRPEKLAETA

SEQ ID NO: 67700 - protein, 385 aa, Sulfitobacter sp. EE-36
MAKRDYYETLGVAKGASADEIKKGYRTKAKELHPDRNADNPNAEAQFKEANEAYEVLKDPEKKAAYDRYGHAAFEGGMGGGGGHRGGGFGGGGQGDFSSAFSDVFDDLFGDFMGGQRGGGGRRAARGADLRYNLGITLEDAYRGMQKSINVPTSVACDSCNGSGSEGGAEPTTCPTCSGMGKVRAQQGFFTVERTCPTCSGMGQIVKNPCKSCRGAGRVEKDRALSVNIPAGVETGTRIRLAGEGEAGMRGGPSGDLYIFIEVQDHKLFERDGPNLFCRVPVSMSTAALGGSIEVPTIDGGRGRVQIPAGSQSGRQMRLRGKGMPPLRGGGTGDMIIELAVETPVNLTSRQKELLQEFEKESSNNNPESSSFFSSVKSFWDSMKG

SEQ ID NO: 67701 - protein, 426 aa, Oceanobacillus iheyensis HTE831
MVADKAADSSNVNQENMDVLNTTQTIIKSALDKLGYPEEVFELLKEPMRILTVRIPVRMDDGNVKVFTGYRAQHNDAVGPTKGGIRFHPNVTETEVKALSIWMSLKSGIVDLPYGGAKGGIICDPREMSFRELEALSRGYVRAVSQIVGPTKDIPAPDVFTNSQIMAWMMDEYSKIDEFNNPGFITGKPIVLGGSHGRESATAKGVTIVLNEAAKKKGIDIKGARVVIQGFGNAGSFLAKFLHDAGAKVVAISDAYGALYDPEGLDIDYLLDRRDSFGTVTKLFNNTISNDALFELDCDIIVPAAVENQITRENAHNIKASIVVEAANGPTTMEATKILTERDILIVPDVLASAGGVTVSYFEWVQNNQGFYWSEEEIDNKLHEIMIKSFNNIYNMSKTRRIDMRLAAYMVGVRKMAEASRFRGWV

SEQ ID NO: 67702 - protein, 977 aa, Oryza sativa
MTPLLLLLLALAAGAGAASFPADFANLFAAKAALSDPSSALAGWDPGLSPSLSPCRWPHLLCSNPSSSSSAAIAAVLLSNLSLAGEFPAPLCELRSLALLDLSYNDLTGPLPGCLAAMPSLRHLDLAGNGFSGEVPRSYGAGFPSLLTLSLAGNELSGELPAFLANVSALEELLLAYNQFAPSPLPETFTGIRRLQVLWLAGCNLVGDIPPSIGSLKSLVNLDLSTNNLTGEIPSSIGGLESVVQLELYSNQLTGSLPEGMSALKKLRFFDAAMNQLSGEIPADLFLAPRLESLHLYQNELTGRVPATVADAAALNDLRLFTNRLVGELPPEFGKKSPLEFLDLSDNRISGEIPATLCSAGKLEQLLMLNNELVGPIPAELGQCRTLTRVRLPNNRLSGAVPPDMWGLPHLYLLELAGNALSGAVAPAIATARNLSQLLISDNRFAGALPPELGSLPNLFELSASNNVFSGPLPASLTVVTTLGRLDLRNNSLSGELPRGVRRWQKLTQLDLADNRLTGNIPAELGDLPVLNSLDLSNNELTGGVPVQLENLKLSLLNLSNNRLAGVLPPLFAGEMYKDSFLGNPGLCTGGSCSSGRRARAGRRGLVGSVTVAVAGVILLLGAAWFAHRYRSQRRWSTEDAAGEKSRWVVTSFHKAEFDEEDILSCLDDEDNVVGTGAAGKVYKAVLGNGARGGDDGAVVAVKKLWANGGAAKKAAAMEAGGGGGGGGKDTFEAEVATLGRIRHKNIVKLWCSLSSGDRRLLVYEYMPNGSLGDLLHGGKGGLLDWPARHRIMVDAAEGLSYLHHDCAPPIVHRDVKSNNILLDADLRAKVADFGVARAVSAAPPTAVSAIAGSCGYIAPEYSYTLRITEKSDVYSFGVVMLELLTGKAPAGPELGEKDLVRWVCGCVERDGVDRVLDARLAGAPRDETRRALNVALLCASSLPINRPSMRSVVKLLLELRPESKEKAMAEEKPLLV

SEQ ID NO: 67703 - protein, 478 aa, Mycobacterium sp. MCS
MREYLKFYIDGQWVDPLRPNALEVDNPTTEEVSGKIAMGSSADVDLAVSAARRAFATWSQTTREERLDVLQAILAEYQKRTDDLADAVTEEMGAPPSLSAGPQVNLGLGHLMTAIDVLKNYEFEEQHGSTLVVKEPVGVCGLITPWNWPINQIACKVFPALATGCTMVLKPSEVAPYSAQIFTEIVDAAGVPAGVYNLVFGDGPGVGVPLSSHPDVDMVSFTGSTRAGIEVARNAAPTVKRVTQELGGKSPNIVLDDDDFAKSVTAGVSVMMMNSGQSCNAPSRMLVPSSRMDEAIEIARQTAGAVKVGDPGDKTAIGPVASKAQFDKIQGLIQKGIDEGATVAVGGTGRPDGLDKGYYVKPTVFANVTNDMTIAREEIFGPVLCILGYDDLDQAIEIANDTEYGLAGYVSAADLDKAREVARRIRAGSVAINHGFDMNAPFGGYKRSGNGREWGQFAFDEFLEIKAALGYAPEAAAK

SEQ ID NO: 67704 - protein, 1346 aa, Burkholderia vietnamiensis G4
MGATGRVIRLHLFIACRRISRILSHHMAGPAPAHEPTMASTTLGVKVDDLLRSRLKDAATRLERTPHWLIKQAIFAYLERIEHGQLPPELSGSSGVTELADGHAAEDDDNSPHPFLEFAQNVQPQSVLRAAITAAYRRPEPECVPFLLGQARLPANLQADVQTLATHLVETLREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVDEASKVVPLGAPHAKIPLPRNLYGDERANSMGLDLSNEHRLASLSSALLASAHHPWRAAPMLADDALADAPARDVRNPADQRDVVGAVSEATSEHVSAALAHAVAAAPIWQATPVDARADCLVRAADLLEAQMHTLMGLIVREAGKSLPNAIAEIREAVDFLRYYAAQIRGEFSNDTHRPLGPVVCISPWNFPLAIFMGQVAAALAAGNTVLAKPAEQTPLIAAQAVRLLREAGVPAGAVQLLPGTGETVGAALVADPRTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDAEAKQTIDTHVAAMKDKGHAVTQLPMPDACAHGTFVPPTLIEIGSIDELKREVFGPVLHVVRYRRSQLDKLLEQIRATGYGLTLGIHTRIDETIAHVIANAHVGNIYVNRNVIGAVVGVQPFGGEGLSGTGPKAGGALYLQRLLATRPSGLPKALAQTLIADGVAEGEQRGNPAAALTALRDWLIEQREPALAARCDGYLSQVPAGATAVLTGPTGERNTYTLGPRGTVLCVAATPSGARAQFAAVLATGNRALFAGSAGEALVAALPAALKGHAAVRKQADAPFDAVLFEGDSDELQTLVKDVAQRPGPIVSVQGVSAGAFENGDAEDYALERLLTERSVSVNTAAAGGNANLMTIG

SEQ ID NO: 67705 - protein, 359 aa, Triticum aestivum
  misc_feature (324)..(324): Xaa can be any naturally occurring amino acid
  misc_feature (335)..(335): Xaa can be any naturally occurring amino acid
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLXRCKANSEATLXGTYKGDATLGEGASESLHVKDYKY

SEQ ID NO: 67706 - protein, 587 aa, Candidatus Kuenenia stuttgartiensis
MSLDPTKFADWQIAEEAEKGMKTVYELADKLGLAKEELLPHGHYVAKVDYKKILKRYEGKPDGKFVDVTAITPTPLGEGKSTTTIGLVQGLGKRGKNVIGTIRQPSGGPTMNIKGSAAGGGLSQCIPLTPFSLGLTGDINAIMNAHNLAMVALTSRMQHEFNYDDATLAKKNLRRLNIDPHRVEMKWIIDFCAQSLRQIVIGLGGKMDGFMMESGFAIAVSSEIMAILSVAKDLKDMRERMGKIVVAYDKSGKPVTTADLEVDGAMTAWMVEALNPNLMQTIEGQPVFVHAGPFANIAIGQSSIVADRIALKLGDYVVTESGFGADIGFEKFWNLKCRFSGSKPNAAVLVATVRALKCHGGAPVPVPGHPLDPCYKEENVGWVEKGTENLTHLINVVKKAGINPVVCINAFYTDTEPEINAVRRLAERAGARVALSKHWLKGGDGAVELADAVIDACNEPNDFKFLYELSTPLRTRIELIAEQVYGADGVDYSPDALAKVKAMEADPETSKLGTCMVKTHLSLTDNPNIKGAPKNWRLSIRDILTFKGAGFVVPIAGNIKLMPGTCSDPAYRRVDVDVETGKVKGLF

SEQ ID NO: 67707 - protein, 298 aa, Saccharomyces cerevisiae
MSTNAKESAGKNIKYPWWYGGAAGIFATMVTHPLDLAKVRLQAAPMPKPTLFRMLESILANEGVVGLYSGLSAAVLRQCTYTTVRFGAYDLLKENVIPREQLTNMAYLLPCSMFSGAIGGLAGNFADVVNIRMQNDSALEAAKRRNYKNAIDGVYKIYRYEGGLKTLFTGWKPNMVRGILMTASQVVTYDVFKNYLVTKLDFDASKNYTHLTASLLAGLVATTVCSPADVMKTRIMNGSGDHQPALKILADAVRKEGPSFMFRGWLPSFTRLGPFTMLIFFAIEQLKKHRVGMPKEDK

SEQ ID NO: 67708 - protein, 335 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 67709 - protein, 380 aa, Gluconobacter oxydans 621H
MATRIDYYESLEVSRTASQDELKKAFRKQAMRYHPDRNPGDDAAEQKFKEINEAYDVLKDEQKRAAYDRYGHDAFEGGMGGMGGGFGGGFAGAGGLGDIFDQMFGDMMGGRRDGGRRTGADVQVQVEITLMEAFTGVTKDVEVRTRVTCEACHGSGSADPKAGSSTCPTCHGAGKVRAQQGFFLVERPCPTCHGSGRTVANPCKVCHGTGTEAKTETISIDIPAGVEDGTRIRMAGKGEAGGEGVQPGDLYVHISVLSHDIFQRDGANIYCRVPLRMTQAALGTEVEVPVVDGGRSKVRIPAGTQTGETFRLRGKGFSVLRSSARGDMYIQVSVETPSHLTKRQRELLEEFEKEAGDDHAKGSPENSGFFAKVRDFFEGR

SEQ ID NO: 67710 - protein, 245 aa, Aspergillus nidulans FGSC A4
MISDKAVLHRLPSMLTFCRLFLPNSITTKVMSTNKSAYGTPTPDTFGGKSWDREEYAKKGAEEEAKRREEGKARYEAKLLGKKWHAPVDYSSLEATTSRKERLDVASMVGKTTIVSAANAVGKRGRGAGFYCSDCDLTFKDNLQLVEHLNSKQHLIATGQSGEVAKATVEDVRQRLRMLAHQKRVREEEERMVWQMDLGERLKEREEQLSKEREEKRRKRNEKRRKGGDGVKQEDSWEGRLGIIA

SEQ ID NO: 67711 - protein, 282 aa, Gluconobacter oxydans 621H
MSQQNFRSILTGSFSTPCDDNPTVAMIEAAYRHHDIDARYINCDVKADGLKDAVAGARAMEWVGFNCSLPHKVAVIEHLDELAESARIIGAVNCVSIRDGRLIGDNTDGKGFLASLNKVGDPSGKKVLLLGAGGAARAIAVELGLVSAAHIMVMNRDPKKAETIAALVRDNTSAKADVQAWDGEASVPEDVDILINATSIGLGDADAMPPLKVETLRKGLIVADVIPNPPAAGSRKQGLHRAGRARDAGQSGRDRRGALAGQDVGRRGDGADPEGYFRRGLT

SEQ ID NO: 67712 - protein, 315 aa, Betula pendula
MENFPVINMEKLNGDERGATMAKINDACENWGFFELVNHSIPHEFLDNLERLAKEHYKKCLEQRFKEMVASKALEGAKAEVNDMDWESTFHVRHLPQSNISEIPDLEDEYRNVLKEFALKLEKLAEELLDLLCENLGLEKGYLKNAFYGSNGPTFGTKVSNYPPCPKPDLIKGLRAHTDAGGIILLFQDDKVSGLQLLKDGQWIDVPPMRHSIVINLGDQLEVITNGKYKSILHRVIAQTDGNRMSIASFYNPGSDAVIYPAPSMVEKETEEKNVYPKFVFEDYMKLYAGLKFQAKEPRFEAMKANGKLGPIATA

SEQ ID NO: 67713 - protein, 68 aa, Triticum aestivum
HYRTSLYKKAGWYRSGIPGISSTHASDSEKVEIKWGNHALSNMVQEAVEVIVDFVNREGPKGWDDPWS

SEQ ID NO: 67714 - protein, 236 aa, Oryza sativa
  misc_feature (207)..(207): Xaa can be any naturally occurring amino acid
  misc_feature (224)..(225): Xaa can be any naturally occurring amino acid
RPAGEKKKKKKKKNSPLWRKRKKISRLLRSLRRQDESRLNRGGAAISIWRAEQARGLCEKKCIKSQEYASEHGLPILKNVLLPKTKGFLCCLQELKSSLDAVYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTGFFLYLSLFSXSVWVKVYVLLSCAYLTXXTYFSHSPPQLI

SEQ ID NO: 67715 - protein, 211 aa, Magnaporthe grisea 70-15
MSEKGKAVASAAGDDTTTPSNPRGIPKAPFVDNVEDYVTSRAEVESTLVRFQEMISKYQFMELNLQRRVAGLKGKLPDIEKTLETVQFLKLSKDGGDPIETSFELNDTLYTKAEIPPTDEVFLWLGANVMLSYPIDEAEELLDSKQKAAKQSLQNCEEDLEFLREQITTMEVALARVYNWDVMQKRKEKAEEDKLKGKDKEKETSKPDNDS

SEQ ID NO: 67716 - protein, 447 aa, Oryza sativa
MPIGVLLIRVTSNVKSTRSIRILFYCHVASQIVAVILATAGAVLSISNFENAFNNTHQRIGLALYGFIWLQPLIGFLRPDRGVRFRSIWYLTHWLLGIAICVVGVANVYIGMHTYHERTGRSVRPWTVLLTVEVSAMAFVYLFQDRWNHVVRQQQQQEAAALGDDDDDDDEQSEEHVYPANDHKEVAVVPDGSHGGGGGSWVGEDGRVWHSHDGLAPHSHEPIYSPGDFSKRAPPLISRRFAERAFTVGIGGPVGTGKTALMLALCRSLREKYSLAAVTNDIFTKEDGEFLIKHGALPEERIRAVETGGCPHAAIREDISINLGPLEELSNLCKADLLLCESGGDNLAANFSRELADYIIYIIDVSGGDKIPRKGGPGITQADLLIINKTDLAPAVGADLAVMERDALRMREGGPFVFAQVKHGVGVEEIVNHILQAWEIATGNKRR

SEQ ID NO: 67717 - protein, 324 aa, Bacteroides thetaiotaomicron VPI-5482
MDSISLIKTPIEAELEDFKALFDTPLSDSNALLDSVITHIRKRNGKMMRPILVLLVARLYGAVTPATLHAAVSLELLHTASLVHDDVVDESTERRGQLSVNAIFNNKVSVLAGDYLLATSLVHAEQTNNYEIIRLVSSLGQKLAEGELLQLSNVSNHSFSEEVYFDVIRKKTAALFAACAEAAALSVQVGEEEVAFARLLGEYIGICFQIKDDIFDYFDSKKIGKPTGNDMLEGKLTLPALYALNTTKDAWAEQIAFKVKEGTATPDEIVRLIEFTKDNGGIEYACRTIEQYKKKAFDLLAALPDSNICLALRTYLDYVVAREK

SEQ ID NO: 67718 - protein, 278 aa, Glycine max
MLYIIGLGLGDEQDITLKGLEAVKKCSKVYMEAYTSLLSFGLSTNGISNLEKLYGKPIILADREMVEEKADEILSEADHAHVAFLVVGDPFGATTHTDLVVRAKKMAIEVKVVHNASVMNAIGVCGLQLYRYGETVSIPFFTETWRPDSFYEKIQRNLSMGLHTLCLLDIRVKEPTLESLCRGRKAYEPPRYMTINTAIEQLLEIVQAREEPAYTEDTECVGLARLGSEDQMIVAGTMKQLQMVDFGAPLHCLVITGQTHPVEEEMLYFYRCRTSIQH

SEQ ID NO: 67719 - protein, 176 aa, Bacteroides thetaiotaomicron VPI-5482
MIMSKETLIKSIREIPDFPIPGILFYDVTTLFKDPWCLQELSNIMFEMYKDKGITKVVGIESRGFIMGPILATRLNAGFIPIRKPGKLPAEVIEESYDKEYGTDTVQIHKDALDENDVVLLHDDLLATGGTMKAACELVKKLKPKKVYVNFIIELKDLNGKSVFGDDVEVESVLTL

SEQ ID NO: 67720 - protein, 346 aa, Burkholderia mallei ATCC 23344
MKALVYHGPGRKSLDERPMPELAAPTDVIVRVTRTTICGTDLHILKGDVPSCEPGRVLGHEGVGVVHRAGGAVSTFKEGDRVLISCISSCGQCEYCRRGMYSHCATGGWILGNRIDGTQAEYVRIPHAQTSLYRIAPGADEEALVMLSDILPTGFECGVLNGRVQPGGTVAIIGAGPIGLAALLTAQFYSPAQIVMIDPDPNRLALARRFGATACIDNGQVDAVAGVKALTGDGVDCAIEAVGIPASFELCQRIIAPGGVIANVGVHGMKADLHLETLWDRNITITTRLVDTSSTPMLLKTVGAGRLDPKQLITHRFSLADIGQAYETFGHAAHTRALKVIVEVSE

SEQ ID NO: 67721 - protein, 327 aa, Arabidopsis thaliana
MNEVAIKRINRSICNGGVGFGVRKVFGKGSFGSVRLFSYKRRCDGETLYATVKTSDDAKSLYEEFQILSKFKGCPRIVQCYGNGVKQRFNDKGYVEYMIPMEYATGGSLNNFMDRFNDRKLPDPMIRKFTRMLLEGLATIHRYGYVHYDIKPENILVFPGSVYKEGAWRYSYKLKISDFGLSKRDGDTKWWHPLKSYAGTRIYMSPESISHGEIGKGLDLWSLGCVVLEMYTGKRPWWHTNYELEDLMKCYEPLFPPNLPCDAKLFLMTCFAPEPDERKDALTLLRQSFFRRDVNKLTKLLKVDNRNDFTLELKKLRQMLSEIRSMR

SEQ ID NO: 67722 - protein, 404 aa, Geobacillus kaustophilus HTA426
MRKPNVVILGAGYGGLMTTVRLQKLIGVNEANITLVNKHDYHYETTWLHEASAGTLHHDRVRYPISDVIDRNKVKFIQDTVTKIIPNEKKVLLENGELTYDYLVIALGFESETFGIKGLKEYAFSIANVDAARQIREHIEYQFATYNAEEEKKEERLTIVVGGAGFTGIEFLGELANRMPELCREYDIDPHKVRIICVEAAPTALPGFDPELVEYAVSQLERKGVEFRIGTAIKECTPDGIIVAKGDDVEEIKAGTVIWAAGVRGSRVIEESGFEAARARIKVDPYLRVPGHEDIFVVGDCSLVIDEETNRPYPPTAQIAMQEGQLCAKNLAVLIRGQGELEPFKPDIKGTVCSLGHDDAIGVVFGKKLWGAKASFMKKVIDNRALYLIGGSSLVMKKGKFKFF

SEQ ID NO: 67723 - protein, 117 aa, Triticum aestivum
MAQEAKDASESILILYRVLEDPSSSSDAVRTKEVAITNLTNYLTKEMIELPIEHVEKKLSQMILDKKFAGTLDQGAGCLIIFEDAKTEAIFPATLETISNVGKVVESLYMRSAKIMA

SEQ ID NO: 67724 - protein, 168 aa, Oryza sativa (japonica cultivar-group)
MAATAAASVAAISPLPGASLPRPVSARVPLLPRASPPTWRLSVGSARARSTRCLAAAGGGGLAPEMRATLDKVVGSHKVVLFMKGTKDFPQCGFSHTVVQILRSLDVPFETLDVLANEALRQGLKEYSSWPTFPQLYIDGEFFGGCDITVDAYKSGELQETLEKAMLS

SEQ ID NO: 67725 - protein, 356 aa, Ralstonia solanacearum
MTKIAVLPGDGIGTEIVAEAVKVLKTLGETFEMETAPVGGAGYEAKGHPLPEDTLKLAKEADAILFGAVGDWKYDTLPRELRPEQAILGLRKHLQLFANFRPAICYPELAGASSMKPEIVAGLDILIVRELTGDIYFGQPRGVRAAPDGLFAGAREGFDTMRYSEPEIRRIAHVAFQAAAKRGKKLCSVDKANVLETFQFWKDIVTDVHKEYPEVELSHMYVDNAAMQLVKAPKNFDVVVTGNMFGDILSDEAAMLTGSIGMLPSASLDANNKGLYEPSHGSAPDIAGKGIANPLATILSAAMMLRYTLGKAEQADRIENAVKKVLAQGYRTGDILTPGCKQVGTVEMGDAVVAAL

SEQ ID NO: 67726 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 67727 - protein, 130 aa, Saccharomyces cerevisiae
MTRSSVLADALNAINNAEKTGKRQVLLRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 67728 - protein, 304 aa, Aspergillus nidulans FGSC A4
MLYLVGLGLADERDITVRGLEVVKKAERVYLEAYTAILLVDKAKLEAFYGRPVIEADRELVETGSDDILANADKVDVAFLVVGDPFGYAFYILDMVFDINSIRAFRATTHTDLVLRARELGIESKVIPNASIMSGIGCTGLQLYNFGQTVSMVFFTETWKPSSYYDRVKENVQIGLHTLVLLDIKVKEQSLENMARGRLIYEPPRFMTVAQCAAQMLETEEERQEGVWGPDSLAVGAARVGAEDQKLVAGTLQELTQVDMGRPLHSLVLLGRRAHDLEKDYIRRFAVDEATFDAAWQNGKYGSS

SEQ ID NO: 67729 - protein, 464 aa, Sulfitobacter sp. EE-36
MPSTVKKQPRKAAAKKPAKSSVVPDMLDANVSVETNAQLIARREQAVPRGVASAAPIYAKYAENAELWDVDGNRYIDFVGGIGVLNTGHRHPKVIAAAKAQEDQYTHTSFQVVPYAPYIELAEKLNALAPGDAPKKTLLVTTGAEAVENAVKIARAATGRPGVIAFTGGYHGRTLLTLGMTGKISPYKKDVGPFPSDIFRAPFPSPRDGITVEDAITGLKNLFLTDAQPERVAAIIIEPVLGEGGYTPVPFEMMHQLREICDQHGIMLIADEVQAGFGRTGKWFAIEHSGVTPDLITVAKSMAGGYPLAGVIGRADVMDAMIPGGLGGTYGGNPVACAAALAAIEAIEEEGLLQRSLDMGDHLKARFAEIGARSAPFRMWDIRGLGAMVAVEFVTDFDTATPDGDFTKRVIAHALKRGLLLLSCGMQGNAVRVMVPLTASDAIIEEGLGIFEASVAAAVAEEAK

SEQ ID NO: 67730 - protein, 886 aa, Medicago truncatula
MAPEPNRAGNGASTSGTAKDEAAAKKKIESEDLSDEDLALKQQLELYVERVQDTDPGLQKVALESMRQEIRTSTSSMTSVPKPLKFLRPHYGTLKAYYETMVESELKKYLADILSVLALTMSAEGERESLKYRLLGSEGDIGSWGHEYVRNLAGEIAQEYAKRQSEEAPIDDLMELVKQIVAFHMKHNAEPEAVDLLMEVEDLDMLTEHVDKTNFKRTCLYLTSSARYLPGPDDMLVLDIAFSIYLKFEEFPNALQIALFMDNLLHVRTVFTSCHDVLRKKQFCYILARHGITFELDEEMVNDDEEREVLQDIINNSKLSEGYLTLARDIEVMEPKSPEDIYKAHLLDGRASAGASVDSARQNLAATFVNAFVNAGFGQDKLMTVASDSSSSGSSGNWLFKNKEHGKTSAAASLGMILLWDVDSGLAQLDKYFHSNDNHVIAGALLGVGIVNCSIKNDCDPAMALLGDFIDKEDSSTRIGAIMGLGIAYAGSQNEQLRYKLAPILSDPKASLDVIAFTAIALGLIYVGSCNEEVAQAIIFTLMDRSESELGEPLTRLLPLGLGLLYLGKQESVEATAEVSKTFNEKIRKYCDMTLLSCAYAGTGNVLKVQNLLGHCSQHLDKGEMHQGPAVLGIAMVAMAEELGVEMAIRSLEHLLQYGEQNIRRAVPLALGLLCISNPKVNVMDTLSRLSHDTDSEVAMAAVISLGLIGAGTNNARIAGMLRNLSSYYYKDTSLLFCVRIAQGLVHLGKGLLTLNPYHSDRVLLSPTALAGLITMLHACLDMKAIVLGKYHYVLYFLVLAMQPRMLLTVDEDLKPLSVPVRVGQAVDVVGQAGRPKTITGFQTHSTPVLLAAGDRAELATEKYLPISPILEGFVILKDNPDYREE

SEQ ID NO: 67731 - protein, 214 aa, Pseudomonas fluorescens PfO-1
MHDLQDLIDNNERWADAITKEDPDFFAKLARQQTPEYLWIGCSDARVPANEIVGMLPGDLFVHRNVANVVLHTDLNCLSVIQYAVDVLKVKHILVTGHYGCGGVRASMQDRQFGLIDGWLRSIRDLYYEKREELARLPTEEEQVDRLCELNVIQQVANVAHTSIIQNAWHRGQSLSIHGCIYGIKDGRWKSLNTTISGFEQLPPQYRLRPVGAP

SEQ ID NO: 67732 - protein, 297 aa, Triticum aestivum
MEAVARASIAAGSHARVPLCRRPRPRHAVRCLRGRPSVACAAAADADVVRLFDAAKLTVDEFVKSGMVVGLGSGAASGLAVQYLGTRLRRGSLTGIVGIPSSVICASEAEKAGIKVGSHEEGAQIDFAFADADVIEEGTLAAVIGRGKTESGQPSFIQEKGIVESADKVAFIIDNDKYVNGIEGSIPVLVKSGNWIDTAEEIDDLFLGDAEVWRRPSIGTAGPSGGDFPLVTKEGHHILDVIFTTPIQDLGKVAEDLEKIVGVVDHGIICNTMPYAVIASKGEVQVLDRKSSVIPNT

SEQ ID NO: 67733 - protein, 393 aa, Arabidopsis thaliana
MPRSMSSDRLVQWDDDSNRPHKKLKHSTTISETSVIEDDADSSTQMGHSIKTIPKSDRWVVTRYLGNSSRSSVYLAESTIEGEEDYLPYEMTIKSIEISQASRLMNEEKFLSRLQNPVVVSFYGHEVTIEKDEKDPLLEKMYYNTLQEYSSGRNLATHIEKNRGKLPEDDVRSLANEILLGLKYIHEEKIIHCDIKPKNIILPFENNLFAQIAGFGKAIKKWSVEYGEGLGHRIGTSRLLPPEVMMDMVLDYGADVWAFGCTVLEMLTGERVWSEFGKLDWEGWKTLIGESGSVPYIPNYLSDKAKDFLAKCLERDPSKRWSVDSLLEHEFLKWIDEDEEEEIYEEEEDDFYDGIEDVDEEYEANLEAEAAVEEEEAIEIDEEYPKEESEDDH

SEQ ID NO: 67734 - protein, 114 aa, Triticum aestivum
HEIQYGGDNASASPRSQYPSQSTAPTVHIPNTSSQQPSPSLFAPGNPGLTQSKNSMVFSSALSSPIRRSLQPYHLEQGGDAGYFANGASRDVNPTASNDSSMDMHSDSPAHDSY

SEQ ID NO: 67735 - protein, 435 aa, Oceanobacillus iheyensis HTE831
MIIDTHPFTVNEKGHLEIGGLDTLDLAKKYGTPLYVYDVALIRNNARAFVQAFTEKGVKGKVAYASKAFSSIAMLQVAKQEGLCLDVISEGELYTALQAEFPTERIHMHGNNKSIEEIRMAVDYEIGCIVIDNFHDIDLLEKVLEEKQKQMDVLIRVTPGVESKTHQYIMTGNEDSKFGFDLQNGQAEQAFKRLHNHQQIRFQGLHCHIGSQIFETSGFQVATDLLFSELEKWNNKYDYQPNVLNLGGGFGIRYTKDDQPLPLDKYIKSMADAVQTHVKQLSMEMPEIWIEPGRSIVGNAGITLYTIGSNKQIPGIREYYSIDGGMTDNIRPALYNAAYEAVIANHPKNPIEKEVSIAGKCCESGDMLIWDLPVPEINSGDVLAVFSTGAYSYSMASHYNRLPNAAVVFVENGRDQLVVRRETYQDVVRNDLSYE

SEQ ID NO: 67736 - protein, 638 aa, Ostreococcus tauri
MRLSSFLPPLIVALVVLSHPLEVLAQVCRECDDATRPCASCTVDVTYVTEPLPVEANATTVEESLFLGSFVLKSVRPETLASWQVTWSFPDGQSLYNGVTDAVLINPGGPGGQPARVVNRLDATVDKAEQKFSFVGHAEDGQDVLGATRIRVNGVLCSQANAENIQVSFTDASCLVREWRFCCGSKIMPPSPSPPFPPPAPPLESLAPPVVVQRGALSSAAQSSTSWLRNGSTMSALVVACIISLVLTIEVCRRVRSFIAGEEAPLADLDLEDVFAPKRKNTLLLPGQCFKARSDDLEGIVVQDDDTARMNAGVLHRHDLFNASFATYVENAGDVIEETSTGEDVVEIQLSSIKLGRLLGRGAHGAVYAGKWNKRTVAVKKLHAMSSVPQNDLKTFVREVQVLSKIAHPKIVRMFGACLKQPHLCIVEEMMDGGSLHTLLHEDKRLTDLDDIARIAMDVALAMSYLHSEHIVHRDLKSHNVLLNSHGAKVADFGIARALEQTIGQTLGTKTNASGAIGGTPAYMAPECFHGDVEAVTTKCDVYSYSVLLWEMLSRRVPWEEYANHMQIIFAVAIQSQRLPLDVLGEDDVVTRTLVDKVMVPAWQTDPDARPDFHEVVDVLRKLLNDRVEARDAVMKEC

SEQ ID NO: 67737 - protein, 241 aa, Brassica napus
  misc_feature (107)..(107): Xaa can be any naturally occurring amino acid
  misc_feature (138)..(138): Xaa can be any naturally occurring amino acid
MGSMSNPNPWSPYDSYNDCSQGVCNIYCPQWCYLIFPPPPPSFLDDEDEDSPSSFSPLLIALIVTLVTAFILVSYYTLVSKYCRRPSRETSSSELSGGVSSSSALAXGDGLNDALIKSITAYKYRKGDGHVHGSDCSXCLSEFEENESLRLLPKCNHAFHLPCIDTWLRSHSNCPLCRAFVTGINNPITQSNAVHPIATESVNRGGGGAAEVNLTAAGYDHRTGDSVVVVEDLEIGLRSQP

SEQ ID NO: 67738 - protein, 486 aa, Vibrio vulnificus YJ016
MEVTAHYIGGKPFVGDTGESFATLNPATGEVLAHIEQADERVLAHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIAKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 67739 - protein, 395 aa, Ustilago maydis 521
MQNPFGLRSESAAVHEPILQDFAPQPPSTKLPWSTHEQRPVGLAIVYACCRVPQEDSIWHKHTHDSFFCIFYAGQPADSFLIHSHIPYLSLGNRLYHHRFHRHLVHDLAQERFWMYTAFPCSSLFSVARRHCNPFNVVSSRSFATTTRVDCSTHLASSFPATTRQSHSASSSTCTSSSKMQPVAQLVSKNKAWSADFLAKKPELAAHLAQRQTPKMLWFGCADSRVPETTICDAEPGDFFVSRNIANQFRLDDTAANALLTFAVQSVGIEHVCVVGHSSCGGVLAAIGGATTPPSEKDIESSALLQHLIPLFKLAKEVCEANPGLSNDELAFKVVSASVKQQIDNIISTSIIQDNWNGVTSPLSGKVMNKVQVHGLFYDIGKQELIDLDLSRSAP

SEQ ID NO: 67740 - protein, 447 aa, Burkholderia mallei ATCC 23344
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAYGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYAS

SEQ ID NO: 67741 - protein, 456 aa, Magnetospirillum magnetotacticum MS-1
MPGMDGYELAELMRGEPRTAQVPIIFVTAAYSDDIHRNRGYDVGAVEYLQKPIDDFILRSKVRVFIDLFLSRRALEAELARTTAMSQVLRESEARLHHAVSEAPIPIMIHAEDGTVTLLSRVWSELTGYGPEDIPTIQDWTRRAYGERSEENLARIQASYGMSGPRAEGEREVITASGEVRVWDLRSAPIEALPDGRRLVISMAIDVTDRYHVQEELAGKTTELERSNADLEQFAYVASHDLREPLRMVNSFLGLLDKKFGSTLPDDAREYIAYAKDGAKRMDSLILDLLEYSRIGRKAVPDQAIDLKPTLDTALSNLALAVEESGATINTPDTMPKLCVDSGEFVRLFQNLIGNALKYRSPDRAPVVSITAEFKGNAWEFRIADNGIGIEPQYFDRVFQIFQRLHARTETSGTGIGLAICKRVVSRHRGRIWVESVPGEGSTFCFTIPAVKAGAA

SEQ ID NO: 67742 - protein, 289 aa, Anabaena variabilis ATCC 29413
MITGKTKLLGVIGHPVEHSLSPVMHNAAIAQLGLDYVYLPFPIAPDNLEAAIALLATIGVVGFSVTIPHKQAIIPLLAEISPVAQAIGAVNTVTRQNNQWVGTNTDIEGFIAPLQTTYKRDWSQQIAVILGNGGAARAVVAGCYQLGFAEIHVVGRNVQRLEEFRHSWDNSPIAENLQVHTWDYLAKLVPQANLLVNTTPIGMYPQVDESPLSTEELANLQTGAIAYDLIYIPKPTQFLQKAQQQGAIAIDGLEMLVQQGVAALKIWLQQDDIPVDVMRQALQKHLGLV

SEQ ID NO: 67743 - protein, 238 aa, Oryza sativa (japonica cultivar-group)
MAYYVINYSKLRIWEFVEYERMVYLDADIQVFDNIDHLFDLDKGAFYAVKDCFCEKTWSHTPQYDIGYCQQRPDEVAWPERELGPPPPLYFNAGMFVHEPGLGTAKDLLDALVVTPPTPFAEQDFLNMFFREQYKPIPNVYNLVLAMLWRHPENVDLDQVKVVHYCAAGSKPWRFTGKEENMNREDIKMLVKRWWDIYNDESLDYKEEEDNADEASQPMRTALAEAGAVKYFPAPSAA

SEQ ID NO: 67744 - protein, 125 aa, Oryza sativa
MAKTEQKACLIVIDGWGIPSAESPKDGDAITNANTPVMDEFAKSKTGYVELEASSLAVGLPEGLMGNSEVGHLNIGAGRVVWQDVVRIDQAVKTGSFATNEVIKKTMEVAKNGNGRLHLCGLVSH

SEQ ID NO: 67745 - protein, 429 aa, Sulfolobus tokodaii str. 7
MAIIDDARKGIITDEMKKISLIEKISPEKVRKRIVEGKIMLIRNEKYPSKKIVAIGKGLTTKVNINIGTSSEVVNLDMELEKVKIANKWGDTLMDLSTGGDLDLIRREIIKHSELPVGTVPVYQVFIESFKHKSGGAYFTEDDLLNTIEKHLKDGVAFMTIHAGLTKDLAIRALKSNRIIPIVSRGGDMIAGWMIHNNSENPYRKNWDYILEMFKQYDAVISLGDALRPGATGDAHDEFQIGELLETARLVKSALEKGVQVMVEGPGHVPLNEIAWDVKLMKKLTGGVPYYVLGPLPIDVGAPYDHIASAIGAAIASASGADLLCYLTPAEHLSLPTVEQVEEGAIAYRIAAHAGDIVKLGKKVRNWDDVVSYYRGKLEWEKMISSLIDPERAMKVYTQFGKPKVRACTMCGGYCPMMWAMEQVRKISD

SEQ ID NO: 67746 - protein, 241 aa, Triticum aestivum
NKFVQKSRLVPVRNSRDIVDPRVRVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 67747 - protein, 420 aa, Shewanella sp. MR-4
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFDQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 67748 - protein, 395 aa, Oryza sativa
  misc_feature (240)..(240): Xaa can be any naturally occurring amino acid
MTTRNGQIKNFTSNSGPQHPAAHGVSRSVLEMNGEVVERAEPHIGSLHRGTEKLIEYKTYLQALPYFDRSDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYXDVYDQLDFDVPVGTRGDCYDRYCIRIEEMRQSVRIIVQCLNQMPSGMIKADDRKLCPPSRSRMKLSMESLIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 67749 - protein, 752 aa, Shewanella sp. MR-4
MTNPVPVNADGSTAYNLSAGQPFPLGATVDDGGVNFALFSAHATGVELCLFDAQGEVETQRIPLTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLFDAAKAHTIRPLSSKREPLPLEQCIIYEMHLKGFTALHPEIDAPLRGTFAGLASNAAIDYLVNLGVNCVELLPVQAFFSEPFLLEKQLSNYWGYNSVGFFAPEPSYLSSEDIGEFRTMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCSKRFIHEQLVANAFDWSSESSSSHAVSPASTPTGARLDWFSRQGEPMSKSLWSESMGRSLCVVLSGNLTATQPQTQGDNLQALLLMVNADEHPLAFTLPVFDGLGPWQCLLHTQTDPQFLTPTEPLDAQSSPTRYLLQDRSLMLFHADFIRN

SEQ ID NO: 67750 - protein, 293 aa, Triticum aestivum
  misc_feature (222)..(222): Xaa can be any naturally occurring amino acid
  misc_feature (267)..(267): Xaa can be any naturally occurring amino acid
LSAHPVFFCYKLYYLFTDVTHILSELEFIIQRVKVSTTPDGRVVNLFFITDGMELLHTKERQEEICSMLIATLGPSLTCEILSAEGFQQGFSSLPPTISEELFRLELDECESSSGPLSAEMKKVQKATINFDNSLSPAHTLLQILCVDQKGLLYDMLRTLKDCNIKVTYGRFWSDKKGFREVDLFIKQADGKKVIDPEKQDALRSRMRSEMLHPLRVMIVNXRGPDTELFVANPVELAGKGRPRVFYDATLALKALGICIFSAEIGXRQHRSANGRSTDSSWMTAKNFPCQTA

SEQ ID NO: 67751 - protein, 319 aa, Thermotoga maritima MSB8
MKKIAVLTSGGDAPGMNAAVRAVVRYGVRQGLEVIGVRRGYSGLIDGDFVKLEYKDVAGITEKGGTILRTSRCEEFKTEEGRELAAKQIKKHGIEGLVVIGGEGSLTGAHLLYEEHKIPVVGIPATIDNDIGLTDMCIGVDTCLNTVMDAVQKLKDTASSHERAFIVEVMGRHSGYIALMAGLVTGAEAIIVPEIPVDYSQLADRILEERRRGKINSIIIVAEGAASAYTVARHLEYRIGYETRITILGHVQRGGSPTAFDRRLALSMGVEAVDALLDGEVDVMIALQGNKFVRVPIMEALSTKKTIDKKLYEIAHMLS

SEQ ID NO: 67752 - protein, 809 aa, Burkholderia vietnamiensis G4
MQFPESWLRTFVDPQLTTDELSHALTMAGLEVESLSKAAPPTSKIVVGRVLEVVKHPDADKLNVCQVDAGTGATLNIVCGAPNVAPGIKVPVALVGAELPPAEEGGKPFAIKLSKLRGVESQGMLCSARELKLSEDHSGLLILPEDTPVGQDIRDTLNLDDTIFEIKLTPNKADCLSVFGIARETAAITGAPLTPIDIKPAHVELDETLPVRIAAPDLCGRFSGRVIRGVNARAKTPQWMVERLERAGQRSVSALVDISNYVMFELGRPSHVFDLDKIHGGIEVRWGKRGESLKLLNGNTVELDETVGVIADDRQVESLAGIMGGDSTAVTLDTTNIYLEAAFWWPDSIRGRARKYNFSTDAAHRFERGVDYATTVEHVERITQLILEICGGKAGPVDDQAVNLPQRAPVKMRVSRANRIIGVKIDADEIANIFTRLGLPFERDDDAFLVTPPSHRFDIEIEEDLIEEVARIYGFEKIPARPPVATSEMRATNETQRSIHDIRHALAARDYAETVNFSFVDAEWEHDFAGNDNPIRLLNPIASQLSVMRTTLFGSLISVLRHNLNRRADRVRVFEAGRVFLTDPSAKAGELTVEGYSQPKRVGALAYGPALDEQWGVATRAVDFFDVKGDLEALLAPAVARFVKAEHPALHPGRSARIEIDGCAVGWIGELHPRLMQKYELPHAPVMFEIDTEALMARALPAPTDVSKFPPVRRDIAVVVDQAVEVQALFDEMKKALAEDACRFVQKVVLFDEFRAKSNTSGGLAAHEKSLAFRVTLQDAAGTLQDEVVDQAIHTLVERMARVGARLRG

SEQ ID NO: 67753 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRQLREAEESGAITVSGSEMFVRQAYEQFEIFTGLPAPKELYWQIMSKY

SEQ ID NO: 67754 - protein, 804 aa, Vibrio vulnificus YJ016
MPIPTKAAMFLEKDMQKNTLWFNSLSMEDVDKVGGKNASLGEMVSNLANAGVSVPNGFATTSYAFNQFLDYEGLDERIHQLLDELDVDDVDALRKTGATIRQWVLEAPFPADLEQDIRENYSTLTDGNDEISVAVRSSATAEDLPDASFAGQQETFLNVRGIDAVLEATKHVYASLFNDRAISYRVHQGFDHRGIALSAGIQRMVRSDKAASGVMFTLDTESGFDKVVFITSAWGLGEMVVQGAVNPDEFYVHKPLLEAGQAPIVKKTFGSKLSKMIYANSQVIGKQVEIVDTSEAERNQFSLTDAEIVELAKQAMIIEKHYQRPMDIEWAKDGIDGQLYIVQARPETVCSQSDANVIERYELSHKAEVLIEGRAIGQRIGSGVVRLVDSLDQMSLVQTGDVLVTDMTDPDWEPVMKKASAIVTNRGGRTCHAAIIARELGIPAIVGCGNATSQLTDGDLVTVSCAEGETGYVYQGQLDFEVRRSSVDELPMLPTKVMMNVGNPDRAFDFAQIPNEGVGLARLEFIINKMIGIHPKALLNFDQQSESLKAEISQRIRGYQDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAAQVVDLLAKFDLRRGEQGLKVIMMCELPSNAVLADEFLKYFDGFSIGSNDMTQLTLGLDRDSGDVAHLFDERNPAVKAMLKMAIDAATKAGKYVGICGQGPSDHEDFAEWLMEQGISSVSLNPDTVIDTWIQLGKANQK

SEQ ID NO: 67755 - protein, 663 aa, Debaryomyces hansenii CBS767
MLEGEFQASVKLTYKTSSQTTTDIAGQVNPKLVYDPCDNDIPIAQVYGKMKPTPEILKNSDLLQLVSEWVAKFSKVLEDISESPTSNINELDSIFAPHSFWKDHLCLSWDFHQYSDLGQIKDFLSKQIPYFQLQNFQINRTADLRYDNSISIATIQDSTGEQPIPIQLVQFIVNFDNCYGKGSGVIRLIPVDNKLIAYSVYTGLESIKGNEEQLGFNRPEGVNHGQHKARTSWLENREKDFIWGDSSKQPTVLVVGGGQSGLNIAARLKCMGVDTLIVEKNPNIGDNWRNRYKFLVLHDPVWADHLAYMNFPDTWPIFTPKDKLGDWFENYAKNMELSFWANKTVVGADFEEDKSTWIVKVIDNDSGKMDTLRPKHVIMATGHSGEPNIPSFEDQHKFKGKIVHSSQHSTGKMYQGENALVVGCCNSGHDIAQDFYEQGAKPILVQRSSTCIFTAEVGGEITNEGLYEEGGPPIDTADLLSQSMPWKLLNLTLQQQTRRIVSLEKELHDSLKNVGFNIDYGYGGTGLPGKYSRRGGGYYIDVGCSRLIAERKILVKNGQSIHKFTEDGVVFSDGSTIGNVAIVVLATGYSNMKESARKIFGSTVADRLNPVWGLDDEGETKVMYRDSGHPNFWYMGGNLLLTRYFSKKLALRIIAQERDFIKD

SEQ ID NO: 67756 - protein, 128 aa, Thermotoga maritima MSB8
MKRFVETDKAPKAIGPYSQAVVVGNMMFVSGQIPIDPETGELVQGTIEEKTERVLENLKAILEAGGFSLKDVVKVTVFTTSMDYFQRVNEVYSRYFGDHRPARSFVAVAQLPRNVEIEIEAIAVKEGE

SEQ ID NO: 67757 - protein, 454 aa, Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 67758 - protein, 382 aa, Oryza sativa (japonica cultivar-group)
MAFALTRSSAMKTSLCVLLCILVISEVVGVPRCAAALGINYGQVGNNLPSPAQVVSLLASLRIGKVRIYDANPQVLAAFAGTGIELIVTVPNDLVRPMAASPGEALQWVSSSVRPYFPATRVTGIAVGNEVLTDDDEALKAALVPAMRNLHAALAQLGMDGYVHVSTASSLAVLATSYPPSQGAFTAEVAPLMAQFLRFLAETNAPFWINAYPYFAYKGDPTRVSLDYALSNPYHVGAIDPYTRLQYTSMLYAQVDAVAYATSQLGYNNIPVYVSETGWPSKGDTDEVGATVENARAYNRNLLLRQAAGEGTPLRPRQRLEVYLFALFNENMKPGPTSERNYGLYQPDGRTMVYNVGLMQQSTSAASLSLAASPATKTVSAH

SEQ ID NO: 67759 - protein, 394 aa, Oryza sativa (japonica cultivar-group)
MASPPAKKVLVPIASGTEPMEAVITVDVLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNAVESRVQIDGNCVTSRGPGTAMEYSVVLVEQLYGKEKADEVAGPMVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 67760 - protein, 566 aa, Citrus x paradisi
MSPSLVANADLSPVTSGTVKGRVASVYSELQTSRIDHALPLPSVLKNPFKIVDGPASSAAGNPDEIAKLFPNLFGQPSALLVPNGADAVRSDEKLKIGVVLSGGQAPGGHNVISGIYDYLQDRAKGSVLYGFRGGPAGIMKCKYVELTSNYIYPYRNQGGFDMICSGRDKIETPEQFKQATETAVKLDLDGLVVIGGDDSNTNACLLAEHFRSKNLKTLVMGCPKTIDGDLKCKEVPASFGFDTACKIYAEMIGNVMIDARSTGKYYHFVRLMGRAASHITLECALQTHPNITIIGEEVAAKKQTLKNVTDYIVDIICKRAELGYNYGVILIPEGLIDFIPEVQQLIAELNEILAHEVVDEGGQWKKKLTKQSLQLFEFLPQAIQEQLMLERDPHGNVQVAKIETEKMLIQMVETELENRKQEGVNKGQFKGQSHFFGYEGRCGLPTNFDATYCYALGYGAGALLHSGKTGLISSVGNLAAPVEEWTVSGTALTALMDVERRHGKFKPVIKKAMVELDGTPFKKFVSMRDEWALNNRYISPGPIQFTGPTSGDVNHTLLLELGAQV

SEQ ID NO: 67761 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 67762 - protein, 427 aa, Torulaspora delbrueckii
MATHEEFIRTQVFGTVFEITNRYTDLNPVGMGAFGLVCSATDTLAQQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMTEGKPLFPGKDHVHQFSIITDLLGSPPEDVINTICSENTLKFVTSLPHRDPVPFRERFKTVEPEAVDLLEKMLVFDPKKRITAADALVHPYLAPYHDPTDEPVADAKFDWNFNDADLPVDTWRVMMYSEILDFHKIGGGDGQIDTSATFDDQVAAATAAAAHAAAVAQAQAQAHSNSSNSNSSSNVNSKSKAARDSANDAITNYGNQAVHYANEFQQ

SEQ ID NO: 67763 - protein, 151 aa, Xylella fastidiosa Dixon
MLRLLALERAPIQCTFIFHRLHIQMSFQIIHTEKAPAAIGPYSQAVRVGNTVYFSGQIPLDPATGTIVAGDLAVQARRAFDNLRAVAETANGSLSKIVRLGLYLTDLEQFSVVNAVMQEYFQDPFPARSTIQVSGLPKGADFEVDAVMVID

SEQ ID NO: 67764 - protein, 436 aa, Marinobacter sp. ELB17
MSNNTNHLLDDAQSRMADIYERLEVADDSRHRLGQPKRIHQASLSVRMDDGSLRVFPAWRVQYDDTRGPTKGGIRFHPNVTEDEVATLSLWMTLKCAAVDLPFGGAKGGICVDPKTLSRLELERLSRGYIRAFHDVIGPDRDIPAPDVNTNAIVMGWMVDEYAQIARRHVPGVITGKPLGLGGSIGREEATGAGALQVLDLWAKRQNKEPHELSVAIQGFGNAGQNFARLAHHAGYKIVALSDSQGAIYNEDGLDPEPILRHKNRTRELKGMVYCGDSVCDAAETETQTLSGDELLQLDVDVLVLAALENQITDANADHIRAKTIVEIANGPISTGGDQILQGRDITVIPDIVANAGGVIVSHLEWVQNRMGDYWSGDTVEKQLRQRLEREANACFDLADEKAVPLRTAAYLQGVRRIVDAMAQQGTQGYFNDRRG

SEQ ID NO: 67765 - protein, 145 aa, Glycine max
  misc_feature (90)..(90): Xaa can be any naturally occurring amino acid
MLLGKRPRPPIMKRTTSMSEITFDLNTTLDDDPNNPVKGPGGNQNRVWAMVSPRNHSEDTTPDFLRVCFLCKRRLVPARDIFMYKVSINXNYCRGDSAFCSSECREQLMKQDERKDKYRVGSKKQVAEKPNSGSQVNKGETVVAL

SEQ ID NO: 67766 - protein, 144 aa, Hordeum vulgare subsp. vulgare
MPTAGLAAGSNKVDVAIDLGNPLLNRTVDGFLKIGAVGACRVVAEDAFDCLHRGDISKRQLEETLKKMCKEGAYWGAVAGVYVGMEYGVERVRGDRDWKNALIGGIATGALVSAASNNKGNKIAQDAITGGAIATAVEFINYLT

SEQ ID NO: 67767 - protein, 358 aa, Oryza sativa (indica cultivar-group)
MSAYCGKYKDELIKNAAYIGTPGKGILAADESTGTIGKRFASINVENVEENRRSLRELLFCTPGALQYLSGVILFEETLYQKTKDGKLFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 67768 - protein, 744 aa, Burkholderia vietnamiensis G4
MTESASASSVAAPSFDDVLAFVRERAGAARLSTGELLADHSAGTASIMRTLNVDPHAMQAAALFVLTPHLSDPERELTERFGEEVARLVADVRKLLRLGTVSLRAAQNAMPDAGRDAAQQRRTQIEALRKMLLAFAQDIRVVLIRLASRLQSLRYYAAAKADPPPDVARETLEIYAPLANRLGIWQLKWELEDLAFRFEDPVTYKRIAKLLDEKRIEREAYVAQAIERLQHELAQAHIPADVSGRPKHIYSIWRKMRGKELDFSELYDVRAFRVIVPDIKDCYTVLGIVHHLWQPVPKEFDDYISRPKPNGYKSLHTVVIGDDGRAFEVQIRTQEMHRFAEYGVAAHWRYKEAGVRGYGGQFSASDKYDEKIAWLRQLLAWKDDVEDGGEVSGDQAWAQLRETSLDDDHIYVLTPQARVIALPQGATPVDFAYHLHSELGHRCRGARVDGAMVPLNTSLANGQTVEIVAVKEGGPSRDWLNPQLGYLKSSRARQKVRAWFNSIEQEENIAHGRALVEKTLQREGKTSVNLDNLAAKLGFKSPDDLFSVVGKEEFSLRNIEQALSDAPPPEHAPEAPADFEKRSSGASVAHGASTGVLVVGVDALLTQLARCCRPAPPDPISGFVTRGKGMSIHRSDCPTFVRMAERAPERVLQTTWSADVLGGRGASVYPVDLMIEASDRQGLLRDISEVFAREKMNVVGVKTQSRRNTAFMQFTVEVSNAAQVQRACTLLGEVQGVVRAGRKA

SEQ ID NO: 67769 - protein, 399 aa, Oryza sativa (indica cultivar-group)
MFAAICRRRLAALFPQIRGGGGGAYHVQSNPQAALLFHGYSTAAVTGGPDSEPCPDTVSYLVSCGLPPAVARHTAANTRGLRIRSTEKADAVRTLLRSYGFSDADVARIARSAPLLLTVDPDRIIRPKLEFFATMGFQPSKLSTAPLLLARSLEKHLVPTIQFLRSIIGSDDGIRRGFSRIPRALMVSLDNCMRPAVEALHRHGLTGREDVSKVLVLQMGVLMLSPVRIGEIFEDLKAMGMSITDGRFANSFRAMCSMRRATWLRRVALYRSFGLSESEVFEAFKKQPTALLGADETIKKKASFFRDALKLEMREVMVHPVVMAYSFEKTILPRCAVLSVLMREGKINPDIQLLHALLGSAKTFSGRYVDRFAADVPDVVEAYEGKIKFKGFKGQGQGV

SEQ ID NO: 67770 - protein, 376 aa, Brassica napus
MGWIPCSGKSSGKTKKRSDSDENLSRNCSVSASERSKAKSSVSESRSRGSDNIVAQTFTFSELATATRNFRKECLIGEGGFGRVYKGYLASTGQTAAIKQLDHNGLQGNREFLVEVLMLSLLHHPNLVNLIGYCADGDQRLLVYEYMPLGSLEDHLHDISPSKQPLDWNTRMKIAAGAAKGLEYLHDKTMPPVIYRDLKCSNILLGDDYFPKLSDFGLAKLGPVGDKSHVSTRVMGTYGYCAPEYAMTGQLTLKSDVYSFGVVLLEIITGRKAIDNSRCTGEQNLVAWARPLFKDRRKFSQMADPMIQGQYPPRGLYQALAVAAMCVQEQPNLRPVIADVVTALTYLASQRFDPMSQPVQGSLFGPGTPPRSKRVV

SEQ ID NO: 67771 - protein, 162 aa, Malassezia pachydermatis
MSNVFFDITKNGSPLDPIKFKLFDDVVPKTTANFRALCTGEKGFGYAGSHFHRVIPNFMLQGGDFTAGNGTGGKSIYGAKFADENFQLKHSKPGLLSMANAGPNTNGSQFFITTVVAPWLDGKHVVFGEVIEGMDVVKAIEAEGSNSGKTSSRIEIAKCGAC

SEQ ID NO: 67772 - protein, 335 aa, Legionella pneumophila str. Lens
MNFFMMPHDLAQYAIVADIGGTFARFSRVNLVNLQMDKIEVSPCAEFISLESALLTYKNRHSLQEIKHIAIAIACPVIDDLVSMTNCHWQFSITELKQRLGLEVLEVMNDFTAIAMSLPVLSTQDLVQIGNGYLDASKVKVVLGAGTGLGVAYLIPHQHHYSAFAGEGGHADWGAKTEQEWFIYRYLKSKYSHVSYERLLSGQGLENLYQALAAYHSKKVEFLSAAQIISLALNQECFIAHKAVAQFFSSLGSFAGDLALTYGAFGGVYIAGGIMPRLLSLVHQSDFRIQFEDKGRFSDFNALIPTYVIAASQPGILGASVSLKQILTGASHVHF

SEQ ID NO: 67773 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 67774 - protein, 116 aa, Triticum aestivum
VLPLATSLGFELATPFPQWHRRGLPVFQGSEHLLRTDPEDGLEGFFIALFVRKAGPTSEEPSEDATVEVRTKQVRGRRNGGQAFSSLRLSKDDPLVTKGVLGFNLMYHCYFWESMW

SEQ ID NO: 67775 - protein, 473 aa, Legionella pneumophila str. Lens
MAWIVAIIGSIAGFLFGYDEGIIAGSLGLVKNHFNLNATHIGVMASALPFGALFGSLLIGAFMASKCVKRFGRRSLLSFAGFLFFVGALGAGFAETISVLILSRLILGLAIGMASVLTPLYLAETAAVQSRGAVVAIYQLALTVGIVCSYSVNYLLIEQQAWRAMFASSAIPALLLSLGILFMPESPRWLCSVGRHDAAANSLRKLRGKQSVEQELKEIEATLANEPKQGNWLLLFQKPLLPVLMLGTILFCLQQLSGINVVIYFAPEIFKNLGLGSTTGQILATMGIGLVNLLVTIIAILYVDKLGRRKLLLLGFAGTSLSLFALSLFSLNHVAWLSYLSVICLMVYIFSFAISVGPIPHIAMAEIFPLHVRGAGMGMSSMSNWSFNTIVIFSFPVLHQMFGIEMTFVLYAVICFLGFIYAYIYMPETRNISLEQIETYIMSGKPLRFLGREDEEVNAVSTKSESSLLASTN

SEQ ID NO: 67776 - protein, 500 aa, Vitis vinifera
MAVGGFAADDNSRAFSGKVTASVVITCIVAASGGLIFGYDIGISGGVTTMQPFLKKFFPVVLRKAADAKTNIYCVYDSHVLTAFTSSLYIAGLAASLVASRLTRAVGRRNTMIIGGLTFLIGAALNGGAENVAMLILGRILLGFGVGFTNQATPIYLSEMAPPKWRGAFGTSFQFFIGIGVVVANCLNYGTAKISWGWRLSLGLAIVPSVIMTVGALLISDTPSSLVERGKVAQARDSLRKARGKDIDIEPELAELVKTSEAVKAANEEPFVTIFERQYRPHLVMAFAIPFFQQLTGINIIAFYAPVLFQSVGFGSDSALIASIILGCVNLLSIIVSTFIVDRYGRRILFLEGGTQMIIGQVAVACVLAVTTGVSGTKDIPRGYAVLVLVLMCIYAAGFGWSWGPLSWLIPSEIFPMKIRTTGQAISVAVNFATTFVLAQTFLTMLCHFKYGTFLFYAGWLIAMTLFVILFVPETKGIPLESMYQVWERHWFWRRFVSLP

SEQ ID NO: 67777 - protein, 549 aa, Shewanella oneidensis MR-1
MTLASIRRGYHVIKTLLQYGLDDVLPPKMTPWYFTLARNSLFWIRNKHKDKSGGERLKLAMQELGPVYIKLGQMLSTRRDLLSDEWATELAMLQDKVPPFDGALARLAIEAELKAPIETFFDDFNETPLASASISQVHTATLKSNGKAVVLKVLRPNVETKIQADLLLMSQTAKVIDYLLGEGNRLRPAEVIEDYRVTILGELNLKLEALNAIKLRNNFIDSDALYIPYVYEEFCYPRLMVMERIYGIPVSDIVALKAQGTNFKLLAERGVELFFTQVFRDNFFHADMHPGNIFISRENPENPYYIGLDCGIMGTLSEVDKRYLAENFLAFFNRDYHRIAQLYIESGWVSEKTDLQAFEQAIKVVCEPMFNKPLDEISFGHVLLELFRTARHFDIVVQPQLVLLEKTLLYIEGLGRQLYPQLDLWQTAKPFLEQWMAEQVGPKAMFKKVSTKLPYWSDKLPEFPELIYDNLKLGRKLLSSQQQMLDKYLKYQQQAHKSNYLLITSAILLICGTLLFNQDATLLSPYVCLISGAVLWIIGWRSRPKNRKF

SEQ ID NO: 67778 - protein, 447 aa, Salmonella enterica subsp. enterica serovar Typhi str. CT18
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVKYGGDNKHTNYVQGANIAGFVKVADAMLAQGVI

SEQ ID NO: 67779 - DNA, 12554 bp, artificial
  pMON93039
agcttgatctcgtcaatttttcccttttgtaattttgtaatttataatttactttcctgtatgcttctaactctgtcgttttaaaattttaataaaatttcagtaggggcttgcccctcctgtcctataaaaaaaagttgacgtgaatagatttcattaagaggttggatgttagtgggatgacatgactattagtaggacgagatgatgtggaaagttagtgggagatgatatggatagtttttgctttcatcgaaaggttggaagttagtatgatgacatggctaatatagatacatagatatagactaccaacatggctgcatgcccccaagctctcccactatatatatctctggtagcacatcatcccaattcacaatgcttacaaaaacccatccatcattttagctgttgatacaaaagagctcgaagggagatctaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttgatcccgatttggcaagtgttccagagcaaaagctggaagctctcgtagtctgagcctctttgctgattcatacaagttatgaccatctacatggatcgtctcaccaagaaatttgtagactgcaggatttttccctgaccggagtgcaccagctgggttccaactgaatttataggcaagcggattgtttgctgcagctggagatggcaatccaccacagtaagatgtaaatgcctttatttttccctttcgtgcatgagcttcatcaatcatcttcattgacatcaagtgatctatgccaggatctaggcccatttcacaaagtatagttacacctgcatctttggcagcttggctcaagtttgacatggattcatcaacatagcttgccgttaccatgtgcttcttcaactctatgcatactcctgcaatggcagcatgaaaactagcaggcagcaagctaattacaacctcaacctgagaaacaagatctgaaaggcttccaatatcagcaacatcaagctgggtagcagttgtattttcaataccatcaactgtctcttctgcatctttttgatacaaagatgccacgataacatgaatttgatctgcatcatggtcatcaacaccataggtacatatgtctgggtaagatgccagaaactcagcagctggccgacagactcttccagctccaaaccggtgctgcctgctagttttcatgctgccattgcaggagtatgcatagagttgaagaagcacatggtaacggcaagctatgttgatgaatccatgtcaaacttgagccaagctgccaaagatgcaggtgtaactatactttgtgaaatgggcctagatcctggcatagatcacttgatgtcaatgaagatgattgatgaagctcatgcacgaaagggaaaaataaaggcatttacatcttactgtggtggattgccatctccagctgcagcaaacaatccgcttgcctataaattcagttggaacccagctggtgcactccggtcagggaaaaatcctgcagtctacaaatttcttggtgagacgatccatgtagatggtcataacttgtatgaatcagcaaagaggctcagactacgagagcttccagcttttgctctggaacacttgccaaatcggaattaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcggatccatggtttcgccgacgaatctcctcccggcgcggaagatcacccctgtctcaaatggcggcgcagcgacggcgagcccctcttctccctcggtggccgcacggccacggcgactcccttcaggcctccaatctgtgactggtagagggaaggtttccttggcagccatcactagcacaggtttaacagctaagaccggagtagagcactttggcaccgtgggagtagcaatggtaactccattcacggaaagtggagacatcgatatagctgctggccgcgaggtcgcggcttatctagtcgataaaggcttggattctttggtgctcgcgggcaccactggtgaatccccaacgacaaccgccgctgagaaactagaactgctcaaggccgtgcgtgaggaagtaggggatagggcgaaactaatcgccggtgtcggaaccaataacacgcggacatctgtggaacttgcggaggctgctgcttctgctggcgcagacggccttttagtcgtaactccttattacagtaagccgagccaggagggattgctggcgcacttcggggcaatcgcagcagcaacagaggtgccaatttgcctctacgacattcctggtaggtcaggtattccaattgagtctgataccatgagacgcctgagtgaattacctacgattttggcggtcaaagacgccaaaggggacctggttgcagccacgtcattgatcaaagaaacgggacttgcctggtattcaggcgatgacccactaaaccttgtttggcttgctttgggcggatcaggttttatatccgtaattggacatgcagcccccacagcattaagggagttgtacacaagtttcgaggaaggcgacctggtccgtgcgagggagatcaacgccaaactatcaccgctggtagctgcccagggtcgcttgggtggagtcagcttggcaaaagctgctctgcgtctgcaaggcatcaacgtaggagatcctaggcttccaataatggctccaaatgagcaggaacttgaggctctgcgagaagacatgaaaaaagctggagttctataagaattctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattgatatcggcgcgttaattaagcggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttgtacactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatctcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatca

SEQ ID NO: 67780 - DNA, 9769 bp, artificial
  pMON82053
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 67781 - DNA, 8504 bp, artificial
  pMON99053
gtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctg

SEQ ID NO: 67782 - protein, 554 aa, artificial
  consensus sequence
  misc_feature (1)..(86): Xaa can be any naturally occurring amino acid
  misc_feature (88)..(152): Xaa can be any naturally occurring amino acid
  misc_feature (155)..(158): Xaa can be any naturally occurring amino acid
  misc_feature (160)..(160): Xaa can be any naturally occurring amino acid
  misc_feature (162)..(238): Xaa can be any naturally occurring amino acid
  misc_feature (240)..(245): Xaa can be any naturally occurring amino acid
  misc_feature (247)..(249): Xaa can be any naturally occurring amino acid
  misc_feature (251)..(272): Xaa can be any naturally occurring amino acid
  misc_feature (274)..(293): Xaa can be any naturally occurring amino acid
  misc_feature (297)..(314): Xaa can be any naturally occurring amino acid
  misc_feature (316)..(329): Xaa can be any naturally occurring amino acid
  misc_feature (331)..(391): Xaa can be any naturally occurring amino acid
  misc_feature (393)..(398): Xaa can be any naturally occurring amino acid
  misc_feature (400)..(431): Xaa can be any naturally occurring amino acid
  misc_feature (435)..(436): Xaa can be any naturally occurring amino acid
  misc_feature (439)..(454): Xaa can be any naturally occurring amino acid
  misc_feature (456)..(457): Xaa can be any naturally occurring amino acid
  misc_feature (461)..(474): Xaa can be any naturally occurring amino acid
  misc_feature (476)..(554): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXRPXXXXGXEXXXXXXXXXXXXXXXXXXXXXXXXXXXXXXXXXXXXXXXXXXXXXXXXXXXXXXXXXXXXXXXXXXXXXXXXXXXXXRXXXXXXDXXXWXXXXXXXXXXXXXXXXXXXXXXGXXXXXXXXXXXXXXXXXXXXTTKXXXXXXXXXXXXXXXXXXLXXXXXXXXXXXXXXGXXXXXXXXXXXXXXXXXXXXXXXXXXXXXXXXXXXXXXXXXXXXXXXXXXXXXXXXXXXXXKXXXXXXLXXXXXXXXXXXXXXXXXXXXXXXXXXXXXXXXEDRXXTLXXXXXXXXXXXXXXXXLXXWGYXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67783 - protein, 1114 aa, artificial
  consensus sequence
  misc_feature (1)..(263): Xaa can be any naturally occurring amino acid
  misc_feature (267)..(276): Xaa can be any naturally occurring amino acid
  misc_feature (278)..(278): Xaa can be any naturally occurring amino acid
  misc_feature (280)..(280): Xaa can be any naturally occurring amino acid
  misc_feature (282)..(290): Xaa can be any naturally occurring amino acid
  misc_feature (292)..(296): Xaa can be any naturally occurring amino acid
  misc_feature (302)..(304): Xaa can be any naturally occurring amino acid
  misc_feature (306)..(307): Xaa can be any naturally occurring amino acid
  misc_feature (309)..(309): Xaa can be any naturally occurring amino acid
  misc_feature (312)..(313): Xaa can be any naturally occurring amino acid
  misc_feature (315)..(318): Xaa can be any naturally occurring amino acid
  misc_feature (320)..(320): Xaa can be any naturally occurring amino acid
  misc_feature (325)..(326): Xaa can be any naturally occurring amino acid
  misc_feature (328)..(331): Xaa can be any naturally occurring amino acid
  misc_feature (336)..(336): Xaa can be any naturally occurring amino acid
  misc_feature (338)..(345): Xaa can be any naturally occurring amino acid
  misc_feature (347)..(347): Xaa can be any naturally occurring amino acid
  misc_feature (351)..(352): Xaa can be any naturally occurring amino acid
  misc_feature (355)..(391): Xaa can be any naturally occurring amino acid
  misc_feature (393)..(433): Xaa can be any naturally occurring amino acid
  misc_feature (436)..(436): Xaa can be any naturally occurring amino acid
  misc_feature (438)..(511): Xaa can be any naturally occurring amino acid
  misc_feature (513)..(513): Xaa can be any naturally occurring amino acid
  misc_feature (515)..(566): Xaa can be any naturally occurring amino acid
  misc_feature (568)..(570): Xaa can be any naturally occurring amino acid
  misc_feature (572)..(574): Xaa can be any naturally occurring amino acid
  misc_feature (576)..(576): Xaa can be any naturally occurring amino acid
  misc_feature (578)..(1114): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYCCXXXXXXXXXXIXYXYXXXXXXXXXEXXXXXAALCLXXXPXXHXWYXXTXXXXRXFGFLXXDXXXXYFAIXDXXXXXXXXLXFLEXXRDXXXXXXXXXXXXXXXXXXXXXXXXXXXXXXXXXXXXXLXXXXXXXXXXXXXXXXXXXXXXXXXXXXXXXXXXXXXXXXXPLXGXXXXXXXXXXXXXXXXXXXXXXXXXXXXXXXXXXXXXXXXXXXXXXXXXXXXXXXXXXXXXXXXXXXXXXXXXXWXRXXXXXXXXXXXXXXXXXXXXXXXXXXXXXXXXXXXXXXXXXXXXXXXXXXXXLXXXWXXXCXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67784 - protein, 504 aa, artificial
  consensus sequence
  misc_feature (1)..(15): Xaa can be any naturally occurring amino acid
  misc_feature (17)..(51): Xaa can be any naturally occurring amino acid
  misc_feature (54)..(54): Xaa can be any naturally occurring amino acid
  misc_feature (65)..(65): Xaa can be any naturally occurring amino acid
  misc_feature (77)..(83): Xaa can be any naturally occurring amino acid
  misc_feature (85)..(99): Xaa can be any naturally occurring amino acid
  misc_feature (111)..(111): Xaa can be any naturally occurring amino acid
  misc_feature (114)..(114): Xaa can be any naturally occurring amino acid
  misc_feature (119)..(119): Xaa can be any naturally occurring amino acid
  misc_feature (121)..(121): Xaa can be any naturally occurring amino acid
  misc_feature (125)..(153): Xaa can be any naturally occurring amino acid
  misc_feature (163)..(163): Xaa can be any naturally occurring amino acid
  misc_feature (175)..(175): Xaa can be any naturally occurring amino acid
  misc_feature (177)..(177): Xaa can be any naturally occurring amino acid
  misc_feature (190)..(190): Xaa can be any naturally occurring amino acid
  misc_feature (192)..(192): Xaa can be any naturally occurring amino acid
  misc_feature (197)..(197): Xaa can be any naturally occurring amino acid
  misc_feature (199)..(200): Xaa can be any naturally occurring amino acid
  misc_feature (203)..(203): Xaa can be any naturally occurring amino acid
  misc_feature (206)..(206): Xaa can be any naturally occurring amino acid
  misc_feature (221)..(222): Xaa can be any naturally occurring amino acid
  misc_feature (225)..(227): Xaa can be any naturally occurring amino acid
  misc_feature (231)..(231): Xaa can be any naturally occurring amino acid
  misc_feature (234)..(234): Xaa can be any naturally occurring amino acid
  misc_feature (243)..(245): Xaa can be any naturally occurring amino acid
  misc_feature (248)..(248): Xaa can be any naturally occurring amino acid
  misc_feature (256)..(257): Xaa can be any naturally occurring amino acid
  misc_feature (259)..(260): Xaa can be any naturally occurring amino acid
  misc_feature (262)..(301): Xaa can be any naturally occurring amino acid
  misc_feature (303)..(305): Xaa can be any naturally occurring amino acid
  misc_feature (307)..(307): Xaa can be any naturally occurring amino acid
  misc_feature (312)..(317): Xaa can be any naturally occurring amino acid
  misc_feature (319)..(322): Xaa can be any naturally occurring amino acid
  misc_feature (324)..(345): Xaa can be any naturally occurring amino acid
  misc_feature (347)..(504): Xaa can be any naturally occurring amino acid
XXXXXXXXXXXXXXXPXXXXXXXXXXXXXXXXXXXXXXXXXXXXXXXXXXXVPXARLFGPAIFEXSKLKVLFLGVDXXXXXXXHXXXXXXXXXXXXXXXLPRTYTLTHSDXTAXLTLAXSXTINXXXXXXXXXXXXXXXXXXXXXXXXXXXXXQLQGWYNRLXRDEVVAEWKKVXGXMSLHVHCHISGGXHXLLDLXAXXRYXIFXKELPVVLKAFVHGDXXLFXXXPELXEAXVWVYFHSNXXXFNXVECWGPLXXAXXPXXXXXXXXXXXXXXXXXXXXXXXXXXXXXXXXXXXXXXXXCXXXCXCCFPXXXXXXPXXXXPXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67785 - protein, 88 aa, artificial
  consensus sequence
  misc_feature (4)..(4): Xaa can be any naturally occurring amino acid
  misc_feature (6)..(6): Xaa can be any naturally occurring amino acid
  misc_feature (8)..(10): Xaa can be any naturally occurring amino acid
  misc_feature (12)..(14): Xaa can be any naturally occurring amino acid
  misc_feature (17)..(19): Xaa can be any naturally occurring amino acid
  misc_feature (22)..(24): Xaa can be any naturally occurring amino acid
  misc_feature (27)..(29): Xaa can be any naturally occurring amino acid
  misc_feature (38)..(39): Xaa can be any naturally occurring amino acid
  misc_feature (41)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (54)..(57): Xaa can be any naturally occurring amino acid
  misc_feature (60)..(60): Xaa can be any naturally occurring amino acid
  misc_feature (62)..(66): Xaa can be any naturally occurring amino acid
  misc_feature (69)..(69): Xaa can be any naturally occurring amino acid
  misc_feature (72)..(73): Xaa can be any naturally occurring amino acid
  misc_feature (75)..(75): Xaa can be any naturally occurring amino acid
  misc_feature (79)..(87): Xaa can be any naturally occurring amino acid
MANXAXIXXXVXXXLAXXXIFXXXSHXXXLGSLMEKPXXVXXXXXXXLMXVXKXXXXRMXMXXXXXPGXGAXXRXLPRXXXXXXXXXC

SEQ ID NO: 67786 - protein, 156 aa, artificial
  consensus sequence
  misc_feature (1)..(87): Xaa can be any naturally occurring amino acid
  misc_feature (91)..(98): Xaa can be any naturally occurring amino acid
  misc_feature (100)..(101): Xaa can be any naturally occurring amino acid
  misc_feature (111)..(113): Xaa can be any naturally occurring amino acid
  misc_feature (121)..(122): Xaa can be any naturally occurring amino acid
  misc_feature (124)..(124): Xaa can be any naturally occurring amino acid
  misc_feature (126)..(126): Xaa can be any naturally occurring amino acid
  misc_feature (137)..(137): Xaa can be any naturally occurring amino acid
  misc_feature (140)..(140): Xaa can be any naturally occurring amino acid
  misc_feature (142)..(144): Xaa can be any naturally occurring amino acid
  misc_feature (147)..(147): Xaa can be any naturally occurring amino acid
  misc_feature (149)..(156): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXPTRXXXXXXXXPXXCPPAPRKPKXXXSRSLKVRXXYXSXRMIILNVSREXDCXFXXXSLXNXXXXXXXX

SEQ ID NO: 67787 - protein, 1809 aa, artificial
  consensus sequence
  misc_feature (1)..(399): Xaa can be any naturally occurring amino acid
  misc_feature (401)..(510): Xaa can be any naturally occurring amino acid
  misc_feature (512)..(514): Xaa can be any naturally occurring amino acid
  misc_feature (516)..(519): Xaa can be any naturally occurring amino acid
  misc_feature (522)..(576): Xaa can be any naturally occurring amino acid
  misc_feature (578)..(582): Xaa can be any naturally occurring amino acid
  misc_feature (585)..(587): Xaa can be any naturally occurring amino acid
  misc_feature (590)..(598): Xaa can be any naturally occurring amino acid
  misc_feature (600)..(605): Xaa can be any naturally occurring amino acid
  misc_feature (607)..(610): Xaa can be any naturally occurring amino acid
  misc_feature (612)..(618): Xaa can be any naturally occurring amino acid
  misc_feature (620)..(622): Xaa can be any naturally occurring amino acid
  misc_feature (624)..(627): Xaa can be any naturally occurring amino acid
  misc_feature (629)..(646): Xaa can be any naturally occurring amino acid
  misc_feature (648)..(696): Xaa can be any naturally occurring amino acid
  misc_feature (699)..(700): Xaa can be any naturally occurring amino acid
  misc_feature (702)..(724): Xaa can be any naturally occurring amino acid
  misc_feature (726)..(736): Xaa can be any naturally occurring amino acid
  misc_feature (738)..(738): Xaa can be any naturally occurring amino acid
  misc_feature (743)..(743): Xaa can be any naturally occurring amino acid
  misc_feature (745)..(745): Xaa can be any naturally occurring amino acid
  misc_feature (748)..(754): Xaa can be any naturally occurring amino acid
  misc_feature (756)..(758): Xaa can be any naturally occurring amino acid
  misc_feature (760)..(762): Xaa can be any naturally occurring amino acid
  misc_feature (764)..(768): Xaa can be any naturally occurring amino acid
  misc_feature (770)..(770): Xaa can be any naturally occurring amino acid
  misc_feature (772)..(1809): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXPXXXXALXXXXXXXXXXXXXXXXXXXXXXXXXXXXXXXXXXXXXXXXXXXXXXXXXXXXXXXAXXXXXRLXXXEPXXXXXXXXXAXXXXXXGXXXXAXXXXXXXLXXXPXXXXAXXXXXXXXXXXXXXXXXXLXXXXXXXXXXXXXXXXXXXXXXXXXXXXXXXXXXXXXXXXXXXXXXXXXLLXXQXXXXXXXXXXXXXXXXXXXXXXXAXXXXXXXXXXXPXDFRPXLXQGXXXXXXXKXXXAXXXFXXXXXLXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67788 - protein, 76 aa, artificial
  consensus sequence
  misc_feature (2)..(2): Xaa can be any naturally occurring amino acid
  misc_feature (5)..(5): Xaa can be any naturally occurring amino acid
  misc_feature (13)..(13): Xaa can be any naturally occurring amino acid
  misc_feature (15)..(15): Xaa can be any naturally occurring amino acid
  misc_feature (20)..(20): Xaa can be any naturally occurring amino acid
  misc_feature (25)..(25): Xaa can be any naturally occurring amino acid
  misc_feature (27)..(27): Xaa can be any naturally occurring amino acid
  misc_feature (48)..(63): Xaa can be any naturally occurring amino acid
  misc_feature (65)..(68): Xaa can be any naturally occurring amino acid
  misc_feature (70)..(70): Xaa can be any naturally occurring amino acid
  misc_feature (72)..(76): Xaa can be any naturally occurring amino acid
MXIKXIELCIEIXKXTMEFXVVVAXAXTIFLRQSSPPPPALLRHGLYXXXXXXXXXXXXXXXXPXXXXYXIXXXXX

SEQ ID NO: 67789 - protein, 514 aa, artificial
  consensus sequence
  misc_feature (1)..(149): Xaa can be any naturally occurring amino acid
  misc_feature (152)..(199): Xaa can be any naturally occurring amino acid
  misc_feature (203)..(203): Xaa can be any naturally occurring amino acid
  misc_feature (207)..(209): Xaa can be any naturally occurring amino acid
  misc_feature (212)..(212): Xaa can be any naturally occurring amino acid
  misc_feature (219)..(219): Xaa can be any naturally occurring amino acid
  misc_feature (223)..(223): Xaa can be any naturally occurring amino acid
  misc_feature (225)..(227): Xaa can be any naturally occurring amino acid
  misc_feature (230)..(232): Xaa can be any naturally occurring amino acid
  misc_feature (234)..(236): Xaa can be any naturally occurring amino acid
  misc_feature (238)..(239): Xaa can be any naturally occurring amino acid
  misc_feature (241)..(241): Xaa can be any naturally occurring amino acid
  misc_feature (244)..(245): Xaa can be any naturally occurring amino acid
  misc_feature (248)..(249): Xaa can be any naturally occurring amino acid
  misc_feature (252)..(252): Xaa can be any naturally occurring amino acid
  misc_feature (255)..(256): Xaa can be any naturally occurring amino acid
  misc_feature (258)..(258): Xaa can be any naturally occurring amino acid
  misc_feature (263)..(265): Xaa can be any naturally occurring amino acid
  misc_feature (267)..(284): Xaa can be any naturally occurring amino acid
  misc_feature (287)..(287): Xaa can be any naturally occurring amino acid
  misc_feature (293)..(293): Xaa can be any naturally occurring amino acid
  misc_feature (295)..(295): Xaa can be any naturally occurring amino acid
  misc_feature (298)..(299): Xaa can be any naturally occurring amino acid
  misc_feature (302)..(304): Xaa can be any naturally occurring amino acid
  misc_feature (307)..(307): Xaa can be any naturally occurring amino acid
  misc_feature (311)..(313): Xaa can be any naturally occurring amino acid
  misc_feature (315)..(316): Xaa can be any naturally occurring amino acid
  misc_feature (319)..(320): Xaa can be any naturally occurring amino acid
  misc_feature (322)..(322): Xaa can be any naturally occurring amino acid
  misc_feature (325)..(325): Xaa can be any naturally occurring amino acid
  misc_feature (329)..(329): Xaa can be any naturally occurring amino acid
  misc_feature (332)..(333): Xaa can be any naturally occurring amino acid
  misc_feature (336)..(336): Xaa can be any naturally occurring amino acid
  misc_feature (340)..(340): Xaa can be any naturally occurring amino acid
  misc_feature (343)..(344): Xaa can be any naturally occurring amino acid
  misc_feature (348)..(348): Xaa can be any naturally occurring amino acid
  misc_feature (351)..(360): Xaa can be any naturally occurring amino acid
  misc_feature (362)..(375): Xaa can be any naturally occurring amino acid
  misc_feature (377)..(393): Xaa can be any naturally occurring amino acid
  misc_feature (395)..(514): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAXXXXXXXXXXXXXXXXXXXXXXXXXXXXXXXXXXXXXXXXXXXXXXXXHPLXQIAXXXTHXLLLKQWXKEEXLXXXRVXXXEXXXDXXRXEIXXLYXXFFXFHXXSXLLLFXXXSXXXXXXXXXXXXXXXXXXACXRSWIPXLXSLXXSLXXXWAXRYKXXXEXXLEXXLXREXEDAXLLXXCVXELKXKGXXFDLXKEXXXXXXXXXXRXXXXXXXXXXXXXXWXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67790 - protein, 509 aa, artificial
  consensus sequence
  misc_feature (1)..(215): Xaa can be any naturally occurring amino acid
  misc_feature (217)..(218): Xaa can be any naturally occurring amino acid
  misc_feature (227)..(227): Xaa can be any naturally occurring amino acid
  misc_feature (242)..(242): Xaa can be any naturally occurring amino acid
  misc_feature (248)..(256): Xaa can be any naturally occurring amino acid
  misc_feature (267)..(267): Xaa can be any naturally occurring amino acid
  misc_feature (270)..(270): Xaa can be any naturally occurring amino acid
  misc_feature (273)..(273): Xaa can be any naturally occurring amino acid
  misc_feature (285)..(285): Xaa can be any naturally occurring amino acid
  misc_feature (287)..(287): Xaa can be any naturally occurring amino acid
  misc_feature (293)..(293): Xaa can be any naturally occurring amino acid
  misc_feature (296)..(300): Xaa can be any naturally occurring amino acid
  misc_feature (302)..(309): Xaa can be any naturally occurring amino acid
  misc_feature (311)..(332): Xaa can be any naturally occurring amino acid
  misc_feature (334)..(355): Xaa can be any naturally occurring amino acid
  misc_feature (357)..(362): Xaa can be any naturally occurring amino acid
  misc_feature (364)..(378): Xaa can be any naturally occurring amino acid
  misc_feature (380)..(380): Xaa can be any naturally occurring amino acid
  misc_feature (382)..(382): Xaa can be any naturally occurring amino acid
  misc_feature (385)..(388): Xaa can be any naturally occurring amino acid
  misc_feature (390)..(390): Xaa can be any naturally occurring amino acid
  misc_feature (392)..(392): Xaa can be any naturally occurring amino acid
  misc_feature (395)..(395): Xaa can be any naturally occurring amino acid
  misc_feature (397)..(398): Xaa can be any naturally occurring amino acid
  misc_feature (401)..(412): Xaa can be any naturally occurring amino acid
  misc_feature (414)..(414): Xaa can be any naturally occurring amino acid
  misc_feature (417)..(417): Xaa can be any naturally occurring amino acid
  misc_feature (420)..(436): Xaa can be any naturally occurring amino acid
  misc_feature (438)..(440): Xaa can be any naturally occurring amino acid
  misc_feature (443)..(443): Xaa can be any naturally occurring amino acid
  misc_feature (446)..(463): Xaa can be any naturally occurring amino acid
  misc_feature (465)..(465): Xaa can be any naturally occurring amino acid
  misc_feature (469)..(469): Xaa can be any naturally occurring amino acid
  misc_feature (472)..(509): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXVLPRHTKVXVTGNNRTKSVLVGLXGVVKKXXXXXXXXXAVGLGGWHWLXVLXNGXEVKLQRNALSVXEXPTGNEXDDXXXXXNXXXXXXXXDXXXXXXXXXXXXXXXXXXXXXXDXXXXXXXXXXXXXXXXXXXXXXSXXXXXXSXXXXXXXXXXXXXXXVXLXKLXXXXLXRXYWXHXXFNXXXXXXXXXXXXPXPSXEQXXXXXXXXXXXXXXXXXLXXXVQXHFXXXXXXXXXXXXXXXXXXQXAKRXKTXXXXXXXXXXXXXXXXXXXXXXXXXXXXXXXXXXXXXX

SEQ ID NO: 67791 - protein, 596 aa, artificial
  consensus sequence
  misc_feature (1)..(379): Xaa can be any naturally occurring amino acid
  misc_feature (381)..(381): Xaa can be any naturally occurring amino acid
  misc_feature (387)..(389): Xaa can be any naturally occurring amino acid
  misc_feature (393)..(393): Xaa can be any naturally occurring amino acid
  misc_feature (402)..(402): Xaa can be any naturally occurring amino acid
  misc_feature (404)..(404): Xaa can be any naturally occurring amino acid
  misc_feature (406)..(434): Xaa can be any naturally occurring amino acid
  misc_feature (436)..(440): Xaa can be any naturally occurring amino acid
  misc_feature (442)..(492): Xaa can be any naturally occurring amino acid
  misc_feature (495)..(496): Xaa can be any naturally occurring amino acid
  misc_feature (498)..(498): Xaa can be any naturally occurring amino acid
  misc_feature (500)..(501): Xaa can be any naturally occurring amino acid
  misc_feature (507)..(508): Xaa can be any naturally occurring amino acid
  misc_feature (510)..(511): Xaa can be any naturally occurring amino acid
  misc_feature (513)..(514): Xaa can be any naturally occurring amino acid
  misc_feature (516)..(517): Xaa can be any naturally occurring amino acid
  misc_feature (519)..(535): Xaa can be any naturally occurring amino acid
  misc_feature (537)..(537): Xaa can be any naturally occurring amino acid
  misc_feature (539)..(596): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXGLQRSXXXFRRXGSSGLVWDXRXLXXXXXXXXXXXXXXXXXXXXXXXXXXXXXEXXXXXSXXXXXXXXXXXXXXXXXXXXXXXXXXXXXXXXXXXXXXXXXXXXXXXXXXXRTXXVXPXXDPPSPXXSXXCXXCXXFXXXXXXXXXXXXXXXXXKXRXXXXXXXXXXXXXXXXXXXXXXXXXXXXXXXXXXXXXXXXXXXXXXXXXXXXXXXXXX

SEQ ID NO: 67792 - protein, 1923 aa, artificial
  consensus sequence
  misc_feature (1)..(1577): Xaa can be any naturally occurring amino acid
  misc_feature (1579)..(1579): Xaa can be any naturally occurring amino acid
  misc_feature (1581)..(1581): Xaa can be any naturally occurring amino acid
  misc_feature (1583)..(1583): Xaa can be any naturally occurring amino acid
  misc_feature (1585)..(1588): Xaa can be any naturally occurring amino acid
  misc_feature (1590)..(1592): Xaa can be any naturally occurring amino acid
  misc_feature (1594)..(1597): Xaa can be any naturally occurring amino acid
  misc_feature (1599)..(1599): Xaa can be any naturally occurring amino acid
  misc_feature (1602)..(1603): Xaa can be any naturally occurring amino acid
  misc_feature (1607)..(1608): Xaa can be any naturally occurring amino acid
  misc_feature (1610)..(1610): Xaa can be any naturally occurring amino acid
  misc_feature (1612)..(1613): Xaa can be any naturally occurring amino acid
  misc_feature (1615)..(1619): Xaa can be any naturally occurring amino acid
  misc_feature (1622)..(1628): Xaa can be any naturally occurring amino acid
  misc_feature (1630)..(1632): Xaa can be any naturally occurring amino acid
  misc_feature (1634)..(1634): Xaa can be any naturally occurring amino acid
  misc_feature (1637)..(1638): Xaa can be any naturally occurring amino acid
  misc_feature (1640)..(1640): Xaa can be any naturally occurring amino acid
  misc_feature (1643)..(1645): Xaa can be any naturally occurring amino acid
  misc_feature (1648)..(1652): Xaa can be any naturally occurring amino acid
  misc_feature (1655)..(1655): Xaa can be any naturally occurring amino acid
  misc_feature (1659)..(1659): Xaa can be any naturally occurring amino acid
  misc_feature (1661)..(1662): Xaa can be any naturally occurring amino acid
  misc_feature (1666)..(1667): Xaa can be any naturally occurring amino acid
  misc_feature (1670)..(1698): Xaa can be any naturally occurring amino acid
  misc_feature (1700)..(1737): Xaa can be any naturally occurring amino acid
  misc_feature (1739)..(1741): Xaa can be any naturally occurring amino acid
  misc_feature (1743)..(1747): Xaa can be any naturally occurring amino acid
  misc_feature (1749)..(1819): Xaa can be any naturally occurring amino acid
  misc_feature (1821)..(1821): Xaa can be any naturally occurring amino acid
  misc_feature (1823)..(1823): Xaa can be any naturally occurring amino acid
  misc_feature (1825)..(1829): Xaa can be any naturally occurring amino acid
  misc_feature (1831)..(1846): Xaa can be any naturally occurring amino acid
  misc_feature (1848)..(1857): Xaa can be any naturally occurring amino acid
  misc_feature (1859)..(1923): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXEXKXGXXXXVXXXDXXXXHXSQXXLGEXXKXKXXEXXXXXVKXXXXXXXKXXXGXLSXXKXPQXXXDLXXXXXFEXSHNXKXXSVYXXGYXXXXXXXXXXXXXXXXXXXXXXXXXXXXXAXXXXXXXXXXXXXXXXXXXXXXXXXXXXXXXXXXXXXXEXXXDXXXXXSXXXXXXXXXXXXXXXXXXXXXXXXXXXXXXXXXXXXXXXXXXXXXXXXXXXXXXXXXXXXXXXXXXXXXXXEXPXKXXXXXKXXXXXXXXXXXXXXXXKXXXXXXXXXXKXXXXXXXXXXXXXXXXXXXXXXXXXXXXXXXXXXXXXXXXXXXXXXXXXXXXXXXXXXXXXXXXX

SEQ ID NO: 67793 - protein, 611 aa, artificial
  consensus sequence
  misc_feature (1)..(37): Xaa can be any naturally occurring amino acid
  misc_feature (39)..(40): Xaa can be any naturally occurring amino acid
  misc_feature (42)..(44): Xaa can be any naturally occurring amino acid
  misc_feature (46)..(52): Xaa can be any naturally occurring amino acid
  misc_feature (54)..(56): Xaa can be any naturally occurring amino acid
  misc_feature (58)..(60): Xaa can be any naturally occurring amino acid
  misc_feature (62)..(64): Xaa can be any naturally occurring amino acid
  misc_feature (66)..(67): Xaa can be any naturally occurring amino acid
  misc_feature (72)..(74): Xaa can be any naturally occurring amino acid
  misc_feature (77)..(77): Xaa can be any naturally occurring amino acid
  misc_feature (88)..(88): Xaa can be any naturally occurring amino acid
  misc_feature (92)..(94): Xaa can be any naturally occurring amino acid
  misc_feature (96)..(96): Xaa can be any naturally occurring amino acid
  misc_feature (98)..(98): Xaa can be any naturally occurring amino acid
  misc_feature (101)..(102): Xaa can be any naturally occurring amino acid
  misc_feature (105)..(128): Xaa can be any naturally occurring amino acid
  misc_feature (130)..(130): Xaa can be any naturally occurring amino acid
  misc_feature (132)..(139): Xaa can be any naturally occurring amino acid
  misc_feature (141)..(141): Xaa can be any naturally occurring amino acid
  misc_feature (144)..(145): Xaa can be any naturally occurring amino acid
  misc_feature (147)..(149): Xaa can be any naturally occurring amino acid
  misc_feature (151)..(256): Xaa can be any naturally occurring amino acid
  misc_feature (258)..(258): Xaa can be any naturally occurring amino acid
  misc_feature (262)..(263): Xaa can be any naturally occurring amino acid
  misc_feature (267)..(267): Xaa can be any naturally occurring amino acid
  misc_feature (278)..(278): Xaa can be any naturally occurring amino acid
  misc_feature (282)..(284): Xaa can be any naturally occurring amino acid
  misc_feature (286)..(286): Xaa can be any naturally occurring amino acid
  misc_feature (289)..(289): Xaa can be any naturally occurring amino acid
  misc_feature (291)..(294): Xaa can be any naturally occurring amino acid
  misc_feature (297)..(297): Xaa can be any naturally occurring amino acid
  misc_feature (300)..(308): Xaa can be any naturally occurring amino acid
  misc_feature (310)..(311): Xaa can be any naturally occurring amino acid
  misc_feature (315)..(315): Xaa can be any naturally occurring amino acid
  misc_feature (323)..(323): Xaa can be any naturally occurring amino acid
  misc_feature (327)..(327): Xaa can be any naturally occurring amino acid
  misc_feature (330)..(330): Xaa can be any naturally occurring amino acid
  misc_feature (334)..(335): Xaa can be any naturally occurring amino acid
  misc_feature (337)..(338): Xaa can be any naturally occurring amino acid
  misc_feature (340)..(340): Xaa can be any naturally occurring amino acid
  misc_feature (342)..(342): Xaa can be any naturally occurring amino acid
  misc_feature (344)..(345): Xaa can be any naturally occurring amino acid
  misc_feature (347)..(348): Xaa can be any naturally occurring amino acid
  misc_feature (361)..(361): Xaa can be any naturally occurring amino acid
  misc_feature (366)..(366): Xaa can be any naturally occurring amino acid
  misc_feature (371)..(371): Xaa can be any naturally occurring amino acid
  misc_feature (379)..(379): Xaa can be any naturally occurring amino acid
  misc_feature (381)..(381): Xaa can be any naturally occurring amino acid
  misc_feature (384)..(414): Xaa can be any naturally occurring amino acid
  misc_feature (416)..(416): Xaa can be any naturally occurring amino acid
  misc_feature (420)..(428): Xaa can be any naturally occurring amino acid
  misc_feature (430)..(459): Xaa can be any naturally occurring amino acid
  misc_feature (464)..(465): Xaa can be any naturally occurring amino acid
  misc_feature (467)..(468): Xaa can be any naturally occurring amino acid
  misc_feature (470)..(611): Xaa can be any naturally occurring amino acid
XXXXXXXXXXXXXXXXXXXXXXXXXXXXXXXXXXXXXYXXRXXXKXXXXXXXEXXXEXXXLXXXWXXLLAGXXXQYXHGLAARGVHYXHRPXXXLXDXGFXXLPXXXXXXXXXXXXXXXXXXXXXXXXEXGXXXXXXXXYXSEXXFXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXLRIXXTFYXTQLPGPNYHCXEGSXXXAXLPXPXXXXEVXLIXXXXXXXXXGXXDLIXSSHMIFTXVFVXTYXKYGXXRXXKXLXWXXAXXQSLLIIASRKHYXVDVVXVAWYXVNLVVFFXDXKLXXXXXXXXXXXXXXXXXXXXXXXXXXXXXXXEXPDRXXXXXXXXXPXXXXXXXXXXXXXXXXXXXXXXXXXXXXXXLNGNXXDXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67794 - protein, 389 aa, artificial
  consensus sequence
  misc_feature (1)..(19): Xaa can be any naturally occurring amino acid
  misc_feature (23)..(23): Xaa can be any naturally occurring amino acid
  misc_feature (27)..(38): Xaa can be any naturally occurring amino acid
  misc_feature (47)..(48): Xaa can be any naturally occurring amino acid
  misc_feature (51)..(54): Xaa can be any naturally occurring amino acid
  misc_feature (58)..(58): Xaa can be any naturally occurring amino acid
  misc_feature (60)..(60): Xaa can be any naturally occurring amino acid
  misc_feature (62)..(63): Xaa can be any naturally occurring amino acid
  misc_feature (67)..(67): Xaa can be any naturally occurring amino acid
  misc_feature (69)..(74): Xaa can be any naturally occurring amino acid
  misc_feature (77)..(79): Xaa can be any naturally occurring amino acid
  misc_feature (81)..(81): Xaa can be any naturally occurring amino acid
  misc_feature (84)..(84): Xaa can be any naturally occurring amino acid
  misc_feature (87)..(88): Xaa can be any naturally occurring amino acid
  misc_feature (90)..(95): Xaa can be any naturally occurring amino acid
  misc_feature (97)..(112): Xaa can be any naturally occurring amino acid
  misc_feature (114)..(114): Xaa can be any naturally occurring amino acid
  misc_feature (116)..(118): Xaa can be any naturally occurring amino acid
  misc_feature (121)..(121): Xaa can be any naturally occurring amino acid
  misc_feature (124)..(125): Xaa can be any naturally occurring amino acid
  misc_feature (145)..(145): Xaa can be any naturally occurring amino acid
  misc_feature (148)..(148): Xaa can be any naturally occurring amino acid
  misc_feature (156)..(157): Xaa can be any naturally occurring amino acid
  misc_feature (160)..(160): Xaa can be any naturally occurring amino acid
  misc_feature (172)..(174): Xaa can be any naturally occurring amino acid
  misc_feature (176)..(177): Xaa can be any naturally occurring amino acid
  misc_feature (180)..(188): Xaa can be any naturally occurring amino acid
  misc_feature (191)..(195): Xaa can be any naturally occurring amino acid
  misc_feature (199)..(217): Xaa can be any naturally occurring amino acid
  misc_feature (220)..(220): Xaa can be any naturally occurring amino acid
  misc_feature (228)..(232): Xaa can be any naturally occurring amino acid
  misc_feature (234)..(238): Xaa can be any naturally occurring amino acid
  misc_feature (240)..(246): Xaa can be any naturally occurring amino acid
  misc_feature (256)..(256): Xaa can be any naturally occurring amino acid
  misc_feature (260)..(260): Xaa can be any naturally occurring amino acid
  misc_feature (262)..(262): Xaa can be any naturally occurring amino acid
  misc_feature (265)..(265): Xaa can be any naturally occurring amino acid
  misc_feature (272)..(272): Xaa can be any naturally occurring amino acid
  misc_feature (274)..(389): Xaa can be any naturally occurring amino acid
XXXXXXXXXXXXXXXXXXXMAIXRTGXXXXXXXXXXXXVYVDDYLEXXSTXXXXLQRXLXTXXELDXRXXXXXXQTXXXQXKYXLGXXSXXXXXXNXXXXXXXXXXXXXXXXEXMXXXIEXSQXXALSLCTEKVLLARQAYDLIXSHXKRLDEDLXXFAXEDLKQEGKIPPXXXPXXLPXXXXXXXXXKRXXXXXTPQXXXXXXXXXXXXXXXXXXXDFXLMPPPGSXXXXXKXXXXXMXXXXXXXIDPNEPTYCXCHQXSXGDXMIACDNXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67795 - protein, 474 aa, artificial
  consensus sequence
  misc_feature (1)..(107): Xaa can be any naturally occurring amino acid
  misc_feature (109)..(120): Xaa can be any naturally occurring amino acid
  misc_feature (122)..(122): Xaa can be any naturally occurring amino acid
  misc_feature (124)..(156): Xaa can be any naturally occurring amino acid
  misc_feature (160)..(161): Xaa can be any naturally occurring amino acid
  misc_feature (163)..(163): Xaa can be any naturally occurring amino acid
  misc_feature (165)..(168): Xaa can be any naturally occurring amino acid
  misc_feature (170)..(171): Xaa can be any naturally occurring amino acid
  misc_feature (173)..(174): Xaa can be any naturally occurring amino acid
  misc_feature (181)..(218): Xaa can be any naturally occurring amino acid
  misc_feature (220)..(220): Xaa can be any naturally occurring amino acid
  misc_feature (222)..(224): Xaa can be any naturally occurring amino acid
  misc_feature (226)..(226): Xaa can be any naturally occurring amino acid
  misc_feature (229)..(229): Xaa can be any naturally occurring amino acid
  misc_feature (232)..(234): Xaa can be any naturally occurring amino acid
  misc_feature (236)..(236): Xaa can be any naturally occurring amino acid
  misc_feature (240)..(240): Xaa can be any naturally occurring amino acid
  misc_feature (243)..(247): Xaa can be any naturally occurring amino acid
  misc_feature (251)..(252): Xaa can be any naturally occurring amino acid
  misc_feature (254)..(254): Xaa can be any naturally occurring amino acid
  misc_feature (256)..(256): Xaa can be any naturally occurring amino acid
  misc_feature (258)..(395): Xaa can be any naturally occurring amino acid
  misc_feature (397)..(398): Xaa can be any naturally occurring amino acid
  misc_feature (400)..(474): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXPXPXXXXXXXXXXXXXXXXXXXXXXXXXXXXXXXXXLPAXXLXLXXXXLXXEXXEVLAYLXXXXXXXXXXXXXXXXXXXXXXXXXXXXXXXXXXXXXXHXPXXXCXCFXCYXXXWXRWDXSPXXXXXLIHXXIXAXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXWXXXXXXXXXXXXXXXXXXXXXXXXXXXXXXXXXXXXXXXXXXXXXXXXXXXXXXXXXXXXXXXXXXXXXXXXXXX

SEQ ID NO: 67796 - protein, 202 aa, artificial
  consensus sequence
  misc_feature (1)..(40): Xaa can be any naturally occurring amino acid
  misc_feature (42)..(51): Xaa can be any naturally occurring amino acid
  misc_feature (53)..(73): Xaa can be any naturally occurring amino acid
  misc_feature (75)..(81): Xaa can be any naturally occurring amino acid
  misc_feature (83)..(91): Xaa can be any naturally occurring amino acid
  misc_feature (93)..(105): Xaa can be any naturally occurring amino acid
  misc_feature (108)..(109): Xaa can be any naturally occurring amino acid
  misc_feature (111)..(113): Xaa can be any naturally occurring amino acid
  misc_feature (115)..(115): Xaa can be any naturally occurring amino acid
  misc_feature (120)..(120): Xaa can be any naturally occurring amino acid
  misc_feature (127)..(127): Xaa can be any naturally occurring amino acid
  misc_feature (131)..(132): Xaa can be any naturally occurring amino acid
  misc_feature (134)..(136): Xaa can be any naturally occurring amino acid
  misc_feature (139)..(140): Xaa can be any naturally occurring amino acid
  misc_feature (144)..(152): Xaa can be any naturally occurring amino acid
  misc_feature (159)..(159): Xaa can be any naturally occurring amino acid
  misc_feature (161)..(161): Xaa can be any naturally occurring amino acid
  misc_feature (166)..(166): Xaa can be any naturally occurring amino acid
  misc_feature (169)..(170): Xaa can be any naturally occurring amino acid
  misc_feature (172)..(172): Xaa can be any naturally occurring amino acid
  misc_feature (177)..(177): Xaa can be any naturally occurring amino acid
  misc_feature (180)..(180): Xaa can be any naturally occurring amino acid
  misc_feature (186)..(187): Xaa can be any naturally occurring amino acid
  misc_feature (189)..(191): Xaa can be any naturally occurring amino acid
  misc_feature (194)..(202): Xaa can be any naturally occurring amino acid
XXXXXXXXXXXXXXXXXXXXXXXXXXXXXXXXXXXXXXXXFXXXXXXXXXXSXXXXXXXXXXXXXXXXXXXXXQXXXXXXXRXXXXXXXXXAXXXXXXXXXXXXXGKXXSXXXVXMVDPXEAKRLAXKQMXXIXXXEKXXRRRXXXXXXXXXEAINGAXAXIGLTXGLXXEXQTGKXILXQLAGYXXAXXXLFXXXXXXXXX

SEQ ID NO: 67797 - protein, 156 aa, artificial
  consensus sequence
  misc_feature (5)..(8): Xaa can be any naturally occurring amino acid
  misc_feature (15)..(15): Xaa can be any naturally occurring amino acid
  misc_feature (17)..(22): Xaa can be any naturally occurring amino acid
  misc_feature (31)..(31): Xaa can be any naturally occurring amino acid
  misc_feature (34)..(34): Xaa can be any naturally occurring amino acid
  misc_feature (36)..(37): Xaa can be any naturally occurring amino acid
  misc_feature (51)..(51): Xaa can be any naturally occurring amino acid
  misc_feature (53)..(53): Xaa can be any naturally occurring amino acid
  misc_feature (56)..(56): Xaa can be any naturally occurring amino acid
  misc_feature (65)..(65): Xaa can be any naturally occurring amino acid
  misc_feature (68)..(68): Xaa can be any naturally occurring amino acid
  misc_feature (74)..(74): Xaa can be any naturally occurring amino acid
  misc_feature (89)..(89): Xaa can be any naturally occurring amino acid
  misc_feature (91)..(91): Xaa can be any naturally occurring amino acid
  misc_feature (96)..(96): Xaa can be any naturally occurring amino acid
  misc_feature (112)..(112): Xaa can be any naturally occurring amino acid
  misc_feature (127)..(127): Xaa can be any naturally occurring amino acid
  misc_feature (139)..(139): Xaa can be any naturally occurring amino acid
  misc_feature (142)..(142): Xaa can be any naturally occurring amino acid
  misc_feature (145)..(145): Xaa can be any naturally occurring amino acid
  misc_feature (147)..(147): Xaa can be any naturally occurring amino acid
  misc_feature (151)..(151): Xaa can be any naturally occurring amino acid
  misc_feature (153)..(154): Xaa can be any naturally occurring amino acid
MAGKXXXXQVFHLLXIXXXXXXFFVFSVNVXSEXDXXRAVPPEDKTTTVWXSXIKXSGNDYWAKXKEXLGRGHXRFFPPNIDFRGKDDXAXMGAGXKMKEAVTRSFEHSKDXVEEAARSAAEVACDXAEAVKEKVKRSXSGXETXQXQQSXGXXEL

SEQ ID NO: 67798 - protein, 2311 aa, artificial
  consensus sequence
  misc_feature (1)..(1791): Xaa can be any naturally occurring amino acid
  misc_feature (1795)..(1801): Xaa can be any naturally occurring amino acid
  misc_feature (1803)..(1803): Xaa can be any naturally occurring amino acid
  misc_feature (1807)..(1807): Xaa can be any naturally occurring amino acid
  misc_feature (1813)..(1815): Xaa can be any naturally occurring amino acid
  misc_feature (1817)..(1817): Xaa can be any naturally occurring amino acid
  misc_feature (1819)..(1821): Xaa can be any naturally occurring amino acid
  misc_feature (1823)..(1824): Xaa can be any naturally occurring amino acid
  misc_feature (1826)..(1828): Xaa can be any naturally occurring amino acid
  misc_feature (1830)..(1832): Xaa can be any naturally occurring amino acid
  misc_feature (1834)..(1835): Xaa can be any naturally occurring amino acid
  misc_feature (1837)..(1839): Xaa can be any naturally occurring amino acid
  misc_feature (1841)..(1841): Xaa can be any naturally occurring amino acid
  misc_feature (1844)..(1844): Xaa can be any naturally occurring amino acid
  misc_feature (1846)..(1851): Xaa can be any naturally occurring amino acid
  misc_feature (1853)..(1853): Xaa can be any naturally occurring amino acid
  misc_feature (1858)..(1858): Xaa can be any naturally occurring amino acid
  misc_feature (1861)..(1863): Xaa can be any naturally occurring amino acid
  misc_feature (1865)..(1867): Xaa can be any naturally occurring amino acid
  misc_feature (1869)..(1873): Xaa can be any naturally occurring amino acid
  misc_feature (1877)..(1877): Xaa can be any naturally occurring amino acid
  misc_feature (1882)..(1883): Xaa can be any naturally occurring amino acid
  misc_feature (1886)..(1887): Xaa can be any naturally occurring amino acid
  misc_feature (1890)..(1890): Xaa can be any naturally occurring amino acid
  misc_feature (1892)..(1892): Xaa can be any naturally occurring amino acid
  misc_feature (1895)..(1896): Xaa can be any naturally occurring amino acid
  misc_feature (1898)..(1898): Xaa can be any naturally occurring amino acid
  misc_feature (1905)..(1905): Xaa can be any naturally occurring amino acid
  misc_feature (1907)..(1907): Xaa can be any naturally occurring amino acid
  misc_feature (1912)..(1912): Xaa can be any naturally occurring amino acid
  misc_feature (1915)..(1915): Xaa can be any naturally occurring amino acid
  misc_feature (1918)..(1918): Xaa can be any naturally occurring amino acid
  misc_feature (1920)..(1924): Xaa can be any naturally occurring amino acid
  misc_feature (1927)..(1927): Xaa can be any naturally occurring amino acid
  misc_feature (1929)..(1942): Xaa can be any naturally occurring amino acid
  misc_feature (1944)..(1946): Xaa can be any naturally occurring amino acid
  misc_feature (1948)..(1949): Xaa can be any naturally occurring amino acid
  misc_feature (1951)..(1959): Xaa can be any naturally occurring amino acid
  misc_feature (1961)..(1963): Xaa can be any naturally occurring amino acid
  misc_feature (1965)..(1967): Xaa can be any naturally occurring amino acid
  misc_feature (1969)..(1974): Xaa can be any naturally occurring amino acid
  misc_feature (1976)..(1978): Xaa can be any naturally occurring amino acid
  misc_feature (1980)..(1993): Xaa can be any naturally occurring amino acid
  misc_feature (1996)..(2311): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMSRXXXXXXXRXFFPXGNPFRXXXPXGXXXSXXLXXXLXXXEXXLXXXLXKLXPXXXXXXLXLSWMXLAXXXLXXXHXXXXXLITXLELPXXDWXXKWXDXYLXXSXKLLDICXAXSSELXRLXQGXLXXXXXLHXLXXXXXXXXXXXXXXAXXXLXXWXXXXXXXXXRXXXCXXXLXXXXXXLXXXKXXXXXXXXXXXXXXYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67799 - protein, 1470 aa, artificial
  consensus sequence
  misc_feature (1)..(492): Xaa can be any naturally occurring amino acid
  misc_feature (494)..(498): Xaa can be any naturally occurring amino acid
  misc_feature (501)..(514): Xaa can be any naturally occurring amino acid
  misc_feature (517)..(517): Xaa can be any naturally occurring amino acid
  misc_feature (520)..(522): Xaa can be any naturally occurring amino acid
  misc_feature (524)..(565): Xaa can be any naturally occurring amino acid
  misc_feature (567)..(567): Xaa can be any naturally occurring amino acid
  misc_feature (569)..(593): Xaa can be any naturally occurring amino acid
  misc_feature (596)..(597): Xaa can be any naturally occurring amino acid
  misc_feature (599)..(599): Xaa can be any naturally occurring amino acid
  misc_feature (602)..(646): Xaa can be any naturally occurring amino acid
  misc_feature (648)..(649): Xaa can be any naturally occurring amino acid
  misc_feature (652)..(655): Xaa can be any naturally occurring amino acid
  misc_feature (657)..(657): Xaa can be any naturally occurring amino acid
  misc_feature (661)..(708): Xaa can be any naturally occurring amino acid
  misc_feature (711)..(714): Xaa can be any naturally occurring amino acid
  misc_feature (716)..(717): Xaa can be any naturally occurring amino acid
  misc_feature (719)..(816): Xaa can be any naturally occurring amino acid
  misc_feature (818)..(856): Xaa can be any naturally occurring amino acid
  misc_feature (858)..(1470): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXQGXXXXXXXXXXXXXXGKXTLXXXLXXXXXXXXXXXXXXXXXXXXXXXXXXXXXXXXXXXXXXXXXXDXYXXXXXXXXXXXXXXXXXXXXXXXXXRGXXGXHDXXXXXXXXXXXXXXXXXXXXXXXXXXXXXXXXXXXXXXXXXXXXXPXXDKXXXXGXGDRXXXXXXXXXXXXXXXXXXXXXXXXXXXXXXXXXXXXXXXXXXXXXXXXEGXXXXWXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67800 - protein, 127 aa, artificial
  consensus sequence
  misc_feature (5)..(9): Xaa can be any naturally occurring amino acid
  misc_feature (15)..(16): Xaa can be any naturally occurring amino acid
  misc_feature (18)..(25): Xaa can be any naturally occurring amino acid
  misc_feature (32)..(33): Xaa can be any naturally occurring amino acid
  misc_feature (38)..(46): Xaa can be any naturally occurring amino acid
  misc_feature (50)..(50): Xaa can be any naturally occurring amino acid
  misc_feature (54)..(54): Xaa can be any naturally occurring amino acid
  misc_feature (58)..(58): Xaa can be any naturally occurring amino acid
  misc_feature (62)..(63): Xaa can be any naturally occurring amino acid
  misc_feature (79)..(83): Xaa can be any naturally occurring amino acid
  misc_feature (90)..(90): Xaa can be any naturally occurring amino acid
  misc_feature (118)..(118): Xaa can be any naturally occurring amino acid
  misc_feature (120)..(120): Xaa can be any naturally occurring amino acid
  misc_feature (122)..(122): Xaa can be any naturally occurring amino acid
  misc_feature (125)..(125): Xaa can be any naturally occurring amino acid
  misc_feature (127)..(127): Xaa can be any naturally occurring amino acid
MAALXXXXXYHPLCXXHXXXXXXXXRHGVRSXXVMSCXXXXXXXXXKQKXPEEXEGVXQRTXXRMISEAGKIGKNLKPXXXXXEKKKGDXKDLMLMSLSFAVYVYISQLLVCAYFSWXHXSXPKXSX

SEQ ID NO: 67801 - protein, 1311 aa, artificial
  consensus sequence
  misc_feature (1)..(926): Xaa can be any naturally occurring amino acid
  misc_feature (928)..(930): Xaa can be any naturally occurring amino acid
  misc_feature (938)..(938): Xaa can be any naturally occurring amino acid
  misc_feature (940)..(940): Xaa can be any naturally occurring amino acid
  misc_feature (943)..(944): Xaa can be any naturally occurring amino acid
  misc_feature (947)..(949): Xaa can be any naturally occurring amino acid
  misc_feature (951)..(951): Xaa can be any naturally occurring amino acid
  misc_feature (963)..(963): Xaa can be any naturally occurring amino acid
  misc_feature (975)..(978): Xaa can be any naturally occurring amino acid
  misc_feature (980)..(983): Xaa can be any naturally occurring amino acid
  misc_feature (987)..(987): Xaa can be any naturally occurring amino acid
  misc_feature (990)..(990): Xaa can be any naturally occurring amino acid
  misc_feature (994)..(994): Xaa can be any naturally occurring amino acid
  misc_feature (997)..(997): Xaa can be any naturally occurring amino acid
  misc_feature (999)..(999): Xaa can be any naturally occurring amino acid
  misc_feature (1001)..(1001): Xaa can be any naturally occurring amino acid
  misc_feature (1003)..(1004): Xaa can be any naturally occurring amino acid
  misc_feature (1027)..(1311): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXKPKPWKHXQXITXXQLXXXRXEFWDTAPHYGGXKEIWDALRAAAXXXXEXXXXLAQXIVXSAGXIVXNXDXTXXCYDERGAKYELPKYVLSEPTNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67802 - protein, 185 aa, artificial
  consensus sequence
  misc_feature (1)..(10): Xaa can be any naturally occurring amino acid
  misc_feature (16)..(17): Xaa can be any naturally occurring amino acid
  misc_feature (22)..(25): Xaa can be any naturally occurring amino acid
  misc_feature (27)..(28): Xaa can be any naturally occurring amino acid
  misc_feature (30)..(33): Xaa can be any naturally occurring amino acid
  misc_feature (35)..(36): Xaa can be any naturally occurring amino acid
  misc_feature (40)..(40): Xaa can be any naturally occurring amino acid
  misc_feature (44)..(44): Xaa can be any naturally occurring amino acid
  misc_feature (46)..(46): Xaa can be any naturally occurring amino acid
  misc_feature (48)..(49): Xaa can be any naturally occurring amino acid
  misc_feature (53)..(54): Xaa can be any naturally occurring amino acid
  misc_feature (57)..(57): Xaa can be any naturally occurring amino acid
  misc_feature (59)..(60): Xaa can be any naturally occurring amino acid
  misc_feature (62)..(62): Xaa can be any naturally occurring amino acid
  misc_feature (64)..(64): Xaa can be any naturally occurring amino acid
  misc_feature (66)..(105): Xaa can be any naturally occurring amino acid
  misc_feature (107)..(109): Xaa can be any naturally occurring amino acid
  misc_feature (111)..(112): Xaa can be any naturally occurring amino acid
  misc_feature (116)..(117): Xaa can be any naturally occurring amino acid
  misc_feature (119)..(119): Xaa can be any naturally occurring amino acid
  misc_feature (127)..(129): Xaa can be any naturally occurring amino acid
  misc_feature (131)..(135): Xaa can be any naturally occurring amino acid
  misc_feature (137)..(137): Xaa can be any naturally occurring amino acid
  misc_feature (139)..(140): Xaa can be any naturally occurring amino acid
  misc_feature (143)..(143): Xaa can be any naturally occurring amino acid
  misc_feature (146)..(185): Xaa can be any naturally occurring amino acid
XXXXXXXXXXMGSLMXXGWDSXXXXDXXSXXXXRXXSLTXEEIXAXWXXKKKXXEEXHXXAXSXLXXXXXXXXXXXXXXXXXXXXXXXXXXXXXXXXXXXXXXXXEXXXKXXGWWXXSXWAFLNEPXXXEXXXXXNXYXXQFXVAXXXXXXXXXXXXXXXXXXXXXXXXXXXXXXXXXXXXXXXX

SEQ ID NO: 67803 - protein, 353 aa, artificial
  consensus sequence
  misc_feature (1)..(195): Xaa can be any naturally occurring amino acid
  misc_feature (197)..(205): Xaa can be any naturally occurring amino acid
  misc_feature (207)..(233): Xaa can be any naturally occurring amino acid
  misc_feature (235)..(237): Xaa can be any naturally occurring amino acid
  misc_feature (239)..(307): Xaa can be any naturally occurring amino acid
  misc_feature (312)..(313): Xaa can be any naturally occurring amino acid
  misc_feature (318)..(318): Xaa can be any naturally occurring amino acid
  misc_feature (320)..(320): Xaa can be any naturally occurring amino acid
  misc_feature (322)..(323): Xaa can be any naturally occurring amino acid
  misc_feature (327)..(327): Xaa can be any naturally occurring amino acid
  misc_feature (329)..(329): Xaa can be any naturally occurring amino acid
  misc_feature (338)..(338): Xaa can be any naturally occurring amino acid
  misc_feature (343)..(343): Xaa can be any naturally occurring amino acid
  misc_feature (348)..(353): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXVXXXXXXXXXXXXXXXXXXXXXXXXXXXGXXXGXXXXXXXXXXXXXXXXXXXXXXXXXXXXXXXXXXXXXXXXXXXXXXXXXXXXXXXXXXXXXXXXXXXXXNGGGXXSGSGXGXSXXNQPXRXKVRKQVWAXVLGIXSDSTXXXXXX

SEQ ID NO: 67804 - protein, 716 aa, artificial
  consensus sequence
  misc_feature (1)..(209): Xaa can be any naturally occurring amino acid
  misc_feature (212)..(212): Xaa can be any naturally occurring amino acid
  misc_feature (215)..(217): Xaa can be any naturally occurring amino acid
  misc_feature (220)..(226): Xaa can be any naturally occurring amino acid
  misc_feature (228)..(228): Xaa can be any naturally occurring amino acid
  misc_feature (230)..(231): Xaa can be any naturally occurring amino acid
  misc_feature (233)..(233): Xaa can be any naturally occurring amino acid
  misc_feature (235)..(239): Xaa can be any naturally occurring amino acid
  misc_feature (241)..(246): Xaa can be any naturally occurring amino acid
  misc_feature (253)..(255): Xaa can be any naturally occurring amino acid
  misc_feature (257)..(258): Xaa can be any naturally occurring amino acid
  misc_feature (261)..(261): Xaa can be any naturally occurring amino acid
  misc_feature (264)..(264): Xaa can be any naturally occurring amino acid
  misc_feature (266)..(268): Xaa can be any naturally occurring amino acid
  misc_feature (270)..(272): Xaa can be any naturally occurring amino acid
  misc_feature (275)..(275): Xaa can be any naturally occurring amino acid
  misc_feature (279)..(279): Xaa can be any naturally occurring amino acid
  misc_feature (282)..(282): Xaa can be any naturally occurring amino acid
  misc_feature (286)..(292): Xaa can be any naturally occurring amino acid
  misc_feature (298)..(299): Xaa can be any naturally occurring amino acid
  misc_feature (302)..(369): Xaa can be any naturally occurring amino acid
  misc_feature (371)..(467): Xaa can be any naturally occurring amino acid
  misc_feature (469)..(474): Xaa can be any naturally occurring amino acid
  misc_feature (477)..(490): Xaa can be any naturally occurring amino acid
  misc_feature (492)..(716): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPXWEXXXFCXXXXXXXWXKXXEXKXXXXXYXXXXXXWDDSAAXXXFXXAKXRFXAXXXGXXXDIXLPDXPDXYIDXXXXXXXVDPELXXDLXXXXXXXXXXXXXXXXXXXXXXXXXXXXXXXXXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXGWXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67805 - protein, 232 aa, artificial
  consensus sequence
  misc_feature (1)..(106): Xaa can be any naturally occurring amino acid
  misc_feature (108)..(108): Xaa can be any naturally occurring amino acid
  misc_feature (110)..(111): Xaa can be any naturally occurring amino acid
  misc_feature (113)..(113): Xaa can be any naturally occurring amino acid
  misc_feature (116)..(117): Xaa can be any naturally occurring amino acid
  misc_feature (120)..(120): Xaa can be any naturally occurring amino acid
  misc_feature (124)..(125): Xaa can be any naturally occurring amino acid
  misc_feature (128)..(129): Xaa can be any naturally occurring amino acid
  misc_feature (132)..(132): Xaa can be any naturally occurring amino acid
  misc_feature (137)..(139): Xaa can be any naturally occurring amino acid
  misc_feature (141)..(141): Xaa can be any naturally occurring amino acid
  misc_feature (145)..(145): Xaa can be any naturally occurring amino acid
  misc_feature (148)..(148): Xaa can be any naturally occurring amino acid
  misc_feature (152)..(160): Xaa can be any naturally occurring amino acid
  misc_feature (162)..(165): Xaa can be any naturally occurring amino acid
  misc_feature (167)..(168): Xaa can be any naturally occurring amino acid
  misc_feature (170)..(171): Xaa can be any naturally occurring amino acid
  misc_feature (173)..(174): Xaa can be any naturally occurring amino acid
  misc_feature (178)..(178): Xaa can be any naturally occurring amino acid
  misc_feature (185)..(186): Xaa can be any naturally occurring amino acid
  misc_feature (188)..(188): Xaa can be any naturally occurring amino acid
  misc_feature (195)..(195): Xaa can be any naturally occurring amino acid
  misc_feature (197)..(197): Xaa can be any naturally occurring amino acid
  misc_feature (201)..(201): Xaa can be any naturally occurring amino acid
  misc_feature (204)..(232): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXDXXPXMAXXLGXEGLXXELXXGFXLLMDXXXGXITFXSLXRNAXXXXXXXXXLXXXXDXXLXXMXXEGDXDGDGALXXQXEFCVLMXRXLSPXLMXXXXXXXXXXXXXXXXXXXXXXXXXXXXX

SEQ ID NO: 67806 - protein, 295 aa, artificial
  consensus sequence
  misc_feature (1)..(48): Xaa can be any naturally occurring amino acid
  misc_feature (51)..(55): Xaa can be any naturally occurring amino acid
  misc_feature (57)..(59): Xaa can be any naturally occurring amino acid
  misc_feature (62)..(64): Xaa can be any naturally occurring amino acid
  misc_feature (66)..(70): Xaa can be any naturally occurring amino acid
  misc_feature (72)..(80): Xaa can be any naturally occurring amino acid
  misc_feature (83)..(85): Xaa can be any naturally occurring amino acid
  misc_feature (87)..(88): Xaa can be any naturally occurring amino acid
  misc_feature (92)..(92): Xaa can be any naturally occurring amino acid
  misc_feature (95)..(100): Xaa can be any naturally occurring amino acid
  misc_feature (102)..(102): Xaa can be any naturally occurring amino acid
  misc_feature (104)..(106): Xaa can be any naturally occurring amino acid
  misc_feature (108)..(115): Xaa can be any naturally occurring amino acid
  misc_feature (119)..(119): Xaa can be any naturally occurring amino acid
  misc_feature (122)..(122): Xaa can be any naturally occurring amino acid
  misc_feature (124)..(144): Xaa can be any naturally occurring amino acid
  misc_feature (146)..(146): Xaa can be any naturally occurring amino acid
  misc_feature (148)..(149): Xaa can be any naturally occurring amino acid
  misc_feature (151)..(157): Xaa can be any naturally occurring amino acid
  misc_feature (159)..(159): Xaa can be any naturally occurring amino acid
  misc_feature (162)..(170): Xaa can be any naturally occurring amino acid
  misc_feature (173)..(179): Xaa can be any naturally occurring amino acid
  misc_feature (181)..(181): Xaa can be any naturally occurring amino acid
  misc_feature (186)..(186): Xaa can be any naturally occurring amino acid
  misc_feature (188)..(189): Xaa can be any naturally occurring amino acid
  misc_feature (191)..(191): Xaa can be any naturally occurring amino acid
  misc_feature (195)..(195): Xaa can be any naturally occurring amino acid
  misc_feature (199)..(200): Xaa can be any naturally occurring amino acid
  misc_feature (203)..(204): Xaa can be any naturally occurring amino acid
  misc_feature (207)..(208): Xaa can be any naturally occurring amino acid
  misc_feature (210)..(216): Xaa can be any naturally occurring amino acid
  misc_feature (218)..(218): Xaa can be any naturally occurring amino acid
  misc_feature (221)..(232): Xaa can be any naturally occurring amino acid
  misc_feature (236)..(244): Xaa can be any naturally occurring amino acid
  misc_feature (247)..(251): Xaa can be any naturally occurring amino acid
  misc_feature (255)..(255): Xaa can be any naturally occurring amino acid
  misc_feature (258)..(259): Xaa can be any naturally occurring amino acid
  misc_feature (261)..(263): Xaa can be any naturally occurring amino acid
  misc_feature (265)..(265): Xaa can be any naturally occurring amino acid
  misc_feature (267)..(272): Xaa can be any naturally occurring amino acid
  misc_feature (276)..(281): Xaa can be any naturally occurring amino acid
  misc_feature (283)..(285): Xaa can be any naturally occurring amino acid
  misc_feature (287)..(295): Xaa can be any naturally occurring amino acid
XXXXXXXXXXXXXXXXXXXXXXXXXXXXXXXXXXXXXXXXXXXXXXXXVPXXXXXAXXXTLXXXEXXXXXLXXXXXXXXXDPXXXAXXPPLXRAXXXXXXAXAXXXLXXXXXXXXLRCXGVXPXXXXXXXXXXXXXXXXXXXXXDXHXXKXXXXXXXEXERXXXXXXXXXKLXXXXXXXKXPLRPXTXXNXQAAXRFIXXSLXXLTXXQXXXXXXXSXGEXXXXXXXXXXXXKRKXXXXXXXXXSVXXXXXEFLXKAXXEXXXGXNXXXXXXKGPXXXXXXDXXXDXXXXXXXXX

SEQ ID NO: 67807 - protein, 582 aa, artificial
  consensus sequence
  misc_feature (1)..(385): Xaa can be any naturally occurring amino acid
  misc_feature (388)..(388): Xaa can be any naturally occurring amino acid
  misc_feature (390)..(391): Xaa can be any naturally occurring amino acid
  misc_feature (394)..(395): Xaa can be any naturally occurring amino acid
  misc_feature (399)..(399): Xaa can be any naturally occurring amino acid
  misc_feature (403)..(439): Xaa can be any naturally occurring amino acid
  misc_feature (442)..(443): Xaa can be any naturally occurring amino acid
  misc_feature (445)..(464): Xaa can be any naturally occurring amino acid
  misc_feature (466)..(466): Xaa can be any naturally occurring amino acid
  misc_feature (468)..(468): Xaa can be any naturally occurring amino acid
  misc_feature (471)..(476): Xaa can be any naturally occurring amino acid
  misc_feature (479)..(479): Xaa can be any naturally occurring amino acid
  misc_feature (482)..(482): Xaa can be any naturally occurring amino acid
  misc_feature (486)..(486): Xaa can be any naturally occurring amino acid
  misc_feature (490)..(495): Xaa can be any naturally occurring amino acid
  misc_feature (501)..(504): Xaa can be any naturally occurring amino acid
  misc_feature (509)..(509): Xaa can be any naturally occurring amino acid
  misc_feature (514)..(514): Xaa can be any naturally occurring amino acid
  misc_feature (521)..(542): Xaa can be any naturally occurring amino acid
  misc_feature (544)..(582): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRXSXXEGXXRRPXAPPXXXXXXXXXXXXXXXXXXXXXXXXXXXXXXXXXXXXXPSXXPXXXXXXXXXXXXXXXXXXXXTXEXQRXXXXXXAKXLQXYFKXKKLXXXXXXGPFFGXXXXKNEIXNGRWXMFGFAVXXXXXXXXXXXXXXXXXXXXXXFXXXXXXXXXXXXXXXXXXXXXXXXXXXXXXXXXXXXXXX

SEQ ID NO: 67808 - protein, 382 aa, artificial
  consensus sequence
  misc_feature (1)..(93): Xaa can be any naturally occurring amino acid
  misc_feature (95)..(96): Xaa can be any naturally occurring amino acid
  misc_feature (98)..(99): Xaa can be any naturally occurring amino acid
  misc_feature (101)..(101): Xaa can be any naturally occurring amino acid
  misc_feature (103)..(146): Xaa can be any naturally occurring amino acid
  misc_feature (148)..(152): Xaa can be any naturally occurring amino acid
  misc_feature (155)..(169): Xaa can be any naturally occurring amino acid
  misc_feature (176)..(177): Xaa can be any naturally occurring amino acid
  misc_feature (179)..(179): Xaa can be any naturally occurring amino acid
  misc_feature (185)..(186): Xaa can be any naturally occurring amino acid
  misc_feature (188)..(188): Xaa can be any naturally occurring amino acid
  misc_feature (190)..(190): Xaa can be any naturally occurring amino acid
  misc_feature (200)..(200): Xaa can be any naturally occurring amino acid
  misc_feature (203)..(203): Xaa can be any naturally occurring amino acid
  misc_feature (205)..(205): Xaa can be any naturally occurring amino acid
  misc_feature (207)..(211): Xaa can be any naturally occurring amino acid
  misc_feature (213)..(219): Xaa can be any naturally occurring amino acid
  misc_feature (223)..(223): Xaa can be any naturally occurring amino acid
  misc_feature (226)..(231): Xaa can be any naturally occurring amino acid
  misc_feature (233)..(233): Xaa can be any naturally occurring amino acid
  misc_feature (235)..(239): Xaa can be any naturally occurring amino acid
  misc_feature (241)..(241): Xaa can be any naturally occurring amino acid
  misc_feature (243)..(243): Xaa can be any naturally occurring amino acid
  misc_feature (245)..(246): Xaa can be any naturally occurring amino acid
  misc_feature (248)..(248): Xaa can be any naturally occurring amino acid
  misc_feature (252)..(254): Xaa can be any naturally occurring amino acid
  misc_feature (256)..(256): Xaa can be any naturally occurring amino acid
  misc_feature (258)..(260): Xaa can be any naturally occurring amino acid
  misc_feature (262)..(263): Xaa can be any naturally occurring amino acid
  misc_feature (265)..(273): Xaa can be any naturally occurring amino acid
  misc_feature (275)..(275): Xaa can be any naturally occurring amino acid
  misc_feature (278)..(382): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXLXXAXPXXXXXXXXXXXXXXXXXXXXXXXXXXXXXXXXXXXXXXXXXXXXDXXXXXDDXXXXXXXXXXXXXXXAPGVETXXVXVFPKNXXKXVXAGEETELLVXGLXNXGXXXXXVXXXXXXXHLPXDHXXXXXXNXTXXXXXNXSXPXXSXQATXXXYXFXXXSXXLXXXXXXXXXAXDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67809 - protein, 357 aa, artificial
  consensus sequence
  misc_feature (1)..(45): Xaa can be any naturally occurring amino acid
  misc_feature (47)..(60): Xaa can be any naturally occurring amino acid
  misc_feature (62)..(63): Xaa can be any naturally occurring amino acid
  misc_feature (65)..(69): Xaa can be any naturally occurring amino acid
  misc_feature (73)..(73): Xaa can be any naturally occurring amino acid
  misc_feature (75)..(80): Xaa can be any naturally occurring amino acid
  misc_feature (82)..(83): Xaa can be any naturally occurring amino acid
  misc_feature (85)..(90): Xaa can be any naturally occurring amino acid
  misc_feature (92)..(92): Xaa can be any naturally occurring amino acid
  misc_feature (96)..(167): Xaa can be any naturally occurring amino acid
  misc_feature (172)..(173): Xaa can be any naturally occurring amino acid
  misc_feature (176)..(218): Xaa can be any naturally occurring amino acid
  misc_feature (220)..(231): Xaa can be any naturally occurring amino acid
  misc_feature (233)..(279): Xaa can be any naturally occurring amino acid
  misc_feature (281)..(291): Xaa can be any naturally occurring amino acid
  misc_feature (293)..(293): Xaa can be any naturally occurring amino acid
  misc_feature (300)..(315): Xaa can be any naturally occurring amino acid
  misc_feature (317)..(318): Xaa can be any naturally occurring amino acid
  misc_feature (320)..(321): Xaa can be any naturally occurring amino acid
  misc_feature (324)..(325): Xaa can be any naturally occurring amino acid
  misc_feature (328)..(329): Xaa can be any naturally occurring amino acid
  misc_feature (331)..(357): Xaa can be any naturally occurring amino acid
XXXXXXXXXXXXXXXXXXXXXXXXXXXXXXXXXXXXXXXXXXXXXMXXXXXXXXXXXXXXWXXVXXXXXMLRXGXXXXXXLXXDXXXXXXLXRGKXXXXXXXXXXXXXXXXXXXXXXXXXXXXXXXXXXXXXXXXXXXXXXXXXXXXXXXXXXXXXXXXXXXXXXXXEFSCXXTPXXXXXXXXXXXXXXXXXXXXXXXXXXXXXXXXXXXXXXXXXXXDXXXXXXXXXXXXEXXXXXXXXXXXXXXXXXXXXXXXXXXXXXXXXXXXXXXXXXXXXXXXGXXXXXXXXXXXRXTDSPFPXXXXXXXXXXXXXXXXDXXAXXFIXXFYXXLXXXXXXXXXXXXXXXXXXXXXXXXXXX

SEQ ID NO: 67810 - protein, 190 aa, artificial
  consensus sequence
  misc_feature (1)..(1): Xaa can be any naturally occurring amino acid
  misc_feature (4)..(4): Xaa can be any naturally occurring amino acid
  misc_feature (6)..(10): Xaa can be any naturally occurring amino acid
  misc_feature (12)..(26): Xaa can be any naturally occurring amino acid
  misc_feature (29)..(31): Xaa can be any naturally occurring amino acid
  misc_feature (33)..(34): Xaa can be any naturally occurring amino acid
  misc_feature (36)..(61): Xaa can be any naturally occurring amino acid
  misc_feature (63)..(65): Xaa can be any naturally occurring amino acid
  misc_feature (68)..(71): Xaa can be any naturally occurring amino acid
  misc_feature (73)..(77): Xaa can be any naturally occurring amino acid
  misc_feature (79)..(82): Xaa can be any naturally occurring amino acid
  misc_feature (84)..(86): Xaa can be any naturally occurring amino acid
  misc_feature (90)..(90): Xaa can be any naturally occurring amino acid
  misc_feature (94)..(94): Xaa can be any naturally occurring amino acid
  misc_feature (96)..(98): Xaa can be any naturally occurring amino acid
  misc_feature (100)..(101): Xaa can be any naturally occurring amino acid
  misc_feature (103)..(104): Xaa can be any naturally occurring amino acid
  misc_feature (106)..(106): Xaa can be any naturally occurring amino acid
  misc_feature (109)..(109): Xaa can be any naturally occurring amino acid
  misc_feature (113)..(117): Xaa can be any naturally occurring amino acid
  misc_feature (119)..(120): Xaa can be any naturally occurring amino acid
  misc_feature (123)..(124): Xaa can be any naturally occurring amino acid
  misc_feature (126)..(127): Xaa can be any naturally occurring amino acid
  misc_feature (131)..(133): Xaa can be any naturally occurring amino acid
  misc_feature (136)..(146): Xaa can be any naturally occurring amino acid
  misc_feature (148)..(153): Xaa can be any naturally occurring amino acid
  misc_feature (155)..(155): Xaa can be any naturally occurring amino acid
  misc_feature (157)..(157): Xaa can be any naturally occurring amino acid
  misc_feature (161)..(161): Xaa can be any naturally occurring amino acid
  misc_feature (165)..(165): Xaa can be any naturally occurring amino acid
  misc_feature (167)..(167): Xaa can be any naturally occurring amino acid
  misc_feature (169)..(190): Xaa can be any naturally occurring amino acid
XMAXRXXXXXRXXXXXXXXXXXXXXXSRXXXTXXAXXXXXXXXXXXXXXXXXXXXXXXXXXGXXXPVXXXXGXXXXXVXXXXHXXXQQLXHAPXVXXXKXXRXXVXEVXDPDXXXXXAXXFIXXSXXRKVXXXQDXXXXXXXXXXXPXXXXXXRXAXTLKXVGVXPXGXXXXXXXXXXXXXXXXXXXXXX

SEQ ID NO: 67811 - protein, 439 aa, artificial
  consensus sequence
  misc_feature (1)..(15): Xaa can be any naturally occurring amino acid
  misc_feature (18)..(45): Xaa can be any naturally occurring amino acid
  misc_feature (47)..(63): Xaa can be any naturally occurring amino acid
  misc_feature (67)..(67): Xaa can be any naturally occurring amino acid
  misc_feature (73)..(74): Xaa can be any naturally occurring amino acid
  misc_feature (76)..(83): Xaa can be any naturally occurring amino acid
  misc_feature (85)..(86): Xaa can be any naturally occurring amino acid
  misc_feature (89)..(89): Xaa can be any naturally occurring amino acid
  misc_feature (97)..(97): Xaa can be any naturally occurring amino acid
  misc_feature (99)..(99): Xaa can be any naturally occurring amino acid
  misc_feature (101)..(101): Xaa can be any naturally occurring amino acid
  misc_feature (103)..(104): Xaa can be any naturally occurring amino acid
  misc_feature (106)..(106): Xaa can be any naturally occurring amino acid
  misc_feature (109)..(109): Xaa can be any naturally occurring amino acid
  misc_feature (113)..(113): Xaa can be any naturally occurring amino acid
  misc_feature (117)..(137): Xaa can be any naturally occurring amino acid
  misc_feature (143)..(162): Xaa can be any naturally occurring amino acid
  misc_feature (164)..(164): Xaa can be any naturally occurring amino acid
  misc_feature (166)..(166): Xaa can be any naturally occurring amino acid
  misc_feature (168)..(168): Xaa can be any naturally occurring amino acid
  misc_feature (172)..(173): Xaa can be any naturally occurring amino acid
  misc_feature (176)..(176): Xaa can be any naturally occurring amino acid
  misc_feature (178)..(218): Xaa can be any naturally occurring amino acid
  misc_feature (221)..(221): Xaa can be any naturally occurring amino acid
  misc_feature (223)..(224): Xaa can be any naturally occurring amino acid
  misc_feature (226)..(231): Xaa can be any naturally occurring amino acid
  misc_feature (233)..(235): Xaa can be any naturally occurring amino acid
  misc_feature (237)..(237): Xaa can be any naturally occurring amino acid
  misc_feature (239)..(239): Xaa can be any naturally occurring amino acid
  misc_feature (242)..(243): Xaa can be any naturally occurring amino acid
  misc_feature (249)..(252): Xaa can be any naturally occurring amino acid
  misc_feature (254)..(254): Xaa can be any naturally occurring amino acid
  misc_feature (256)..(256): Xaa can be any naturally occurring amino acid
  misc_feature (260)..(260): Xaa can be any naturally occurring amino acid
  misc_feature (262)..(266): Xaa can be any naturally occurring amino acid
  misc_feature (268)..(270): Xaa can be any naturally occurring amino acid
  misc_feature (272)..(272): Xaa can be any naturally occurring amino acid
  misc_feature (275)..(275): Xaa can be any naturally occurring amino acid
  misc_feature (277)..(281): Xaa can be any naturally occurring amino acid
  misc_feature (284)..(284): Xaa can be any naturally occurring amino acid
  misc_feature (287)..(287): Xaa can be any naturally occurring amino acid
  misc_feature (290)..(291): Xaa can be any naturally occurring amino acid
  misc_feature (294)..(297): Xaa can be any naturally occurring amino acid
  misc_feature (299)..(299): Xaa can be any naturally occurring amino acid
  misc_feature (302)..(302): Xaa can be any naturally occurring amino acid
  misc_feature (304)..(305): Xaa can be any naturally occurring amino acid
  misc_feature (310)..(310): Xaa can be any naturally occurring amino acid
  misc_feature (312)..(313): Xaa can be any naturally occurring amino acid
  misc_feature (318)..(322): Xaa can be any naturally occurring amino acid
  misc_feature (324)..(327): Xaa can be any naturally occurring amino acid
  misc_feature (329)..(329): Xaa can be any naturally occurring amino acid
  misc_feature (331)..(332): Xaa can be any naturally occurring amino acid
  misc_feature (334)..(337): Xaa can be any naturally occurring amino acid
  misc_feature (339)..(339): Xaa can be any naturally occurring amino acid
  misc_feature (341)..(342): Xaa can be any naturally occurring amino acid
  misc_feature (344)..(344): Xaa can be any naturally occurring amino acid
  misc_feature (347)..(347): Xaa can be any naturally occurring amino acid
  misc_feature (349)..(349): Xaa can be any naturally occurring amino acid
  misc_feature (353)..(354): Xaa can be any naturally occurring amino acid
  misc_feature (357)..(357): Xaa can be any naturally occurring amino acid
  misc_feature (359)..(360): Xaa can be any naturally occurring amino acid
  misc_feature (362)..(362): Xaa can be any naturally occurring amino acid
  misc_feature (364)..(364): Xaa can be any naturally occurring amino acid
  misc_feature (368)..(369): Xaa can be any naturally occurring amino acid
  misc_feature (374)..(375): Xaa can be any naturally occurring amino acid
  misc_feature (378)..(378): Xaa can be any naturally occurring amino acid
  misc_feature (381)..(382): Xaa can be any naturally occurring amino acid
  misc_feature (386)..(387): Xaa can be any naturally occurring amino acid
  misc_feature (389)..(389): Xaa can be any naturally occurring amino acid
  misc_feature (391)..(392): Xaa can be any naturally occurring amino acid
  misc_feature (396)..(399): Xaa can be any naturally occurring amino acid
  misc_feature (401)..(401): Xaa can be any naturally occurring amino acid
  misc_feature (403)..(404): Xaa can be any naturally occurring amino acid
  misc_feature (408)..(408): Xaa can be any naturally occurring amino acid
  misc_feature (412)..(412): Xaa can be any naturally occurring amino acid
  misc_feature (415)..(415): Xaa can be any naturally occurring amino acid
  misc_feature (417)..(417): Xaa can be any naturally occurring amino acid
  misc_feature (419)..(420): Xaa can be any naturally occurring amino acid
  misc_feature (422)..(423): Xaa can be any naturally occurring amino acid
  misc_feature (426)..(426): Xaa can be any naturally occurring amino acid
  misc_feature (428)..(429): Xaa can be any naturally occurring amino acid
  misc_feature (431)..(431): Xaa can be any naturally occurring amino acid
  misc_feature (439)..(439): Xaa can be any naturally occurring amino acid
XXXXXXXXXXXXXXXMAXXXXXXXXXXXXXXXXXXXXXXXXXXXXAXXXXXXXXXXXXXXXXXLEEXFGRKGXXFXXXXXXXXPXXELXVRNGSSLXLXLXDXXVXSYXPKVXWKDXXXXXXXXXXXXXXXXXXXXXGGVGLXXXXXXXXXXXXXXXXXXXXWXVXDXDSDXXDAXQXXXXXXXXXXXXXXXXXXXXXXXXXXXXXXXXXXXXXXXXXELXCXXGXXXXXXLXXXYXVXLYXXSMATAXXXXNXGXKPVXLXXXXXSXXXFXKRXGXXXXXGLXGCXYCXXPPXXXXFXLLXPXXEAMKXEXXGWFGXXXXXEXXXXGXWXXEXXXXTXLXXKXSRXYXAPPXXERXKXXYXTXPSKXXTIDQXXGLXFRXXRMGXXDXYXXSPGXXXXKXGXXDYFXCTGXASXLXPXXVXXGEXWXXAXVIEHDNLX

SEQ ID NO: 67812 - protein, 401 aa, artificial
  consensus sequence
  misc_feature (1)..(59): Xaa can be any naturally occurring amino acid
  misc_feature (62)..(67): Xaa can be any naturally occurring amino acid
  misc_feature (70)..(71): Xaa can be any naturally occurring amino acid
  misc_feature (74)..(95): Xaa can be any naturally occurring amino acid
  misc_feature (98)..(98): Xaa can be any naturally occurring amino acid
  misc_feature (100)..(100): Xaa can be any naturally occurring amino acid
  misc_feature (111)..(114): Xaa can be any naturally occurring amino acid
  misc_feature (116)..(215): Xaa can be any naturally occurring amino acid
  misc_feature (218)..(218): Xaa can be any naturally occurring amino acid
  misc_feature (220)..(221): Xaa can be any naturally occurring amino acid
  misc_feature (223)..(223): Xaa can be any naturally occurring amino acid
  misc_feature (225)..(225): Xaa can be any naturally occurring amino acid
  misc_feature (227)..(227): Xaa can be any naturally occurring amino acid
  misc_feature (229)..(231): Xaa can be any naturally occurring amino acid
  misc_feature (235)..(305): Xaa can be any naturally occurring amino acid
  misc_feature (307)..(308): Xaa can be any naturally occurring amino acid
  misc_feature (310)..(310): Xaa can be any naturally occurring amino acid
  misc_feature (314)..(314): Xaa can be any naturally occurring amino acid
  misc_feature (317)..(317): Xaa can be any naturally occurring amino acid
  misc_feature (319)..(320): Xaa can be any naturally occurring amino acid
  misc_feature (322)..(322): Xaa can be any naturally occurring amino acid
  misc_feature (325)..(401): Xaa can be any naturally occurring amino acid
XXXXXXXXXXXXXXXXXXXXXXXXXXXXXXXXXXXXXXXXXXXXXXXXXXXXXXXXXXXFSXXXXXXVPXXARXXXXXXXXXXXXXXXXXXXXXXEPXSXPKVSCIGQIKXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGXMXXFXSXRXAXXXFDWXXXXXXXXXXXXXXXXXXXXXXXXXXXXXXXXXXXXXXXXXXXXXXXXXXXXXXXXXXXXXXXXXXXXXXXPXXEXNLWXRRXMXXPXPLXXXXXXXXXXXXXXXXXXXXXXXXXXXXXXXXXXXXXXXXXXXXXXXXXXXXXXXXXXXXXXXXXXXXXXXXXXXXX

SEQ ID NO: 67813 - protein, 432 aa, artificial
  consensus sequence
  misc_feature (1)..(141): Xaa can be any naturally occurring amino acid
  misc_feature (143)..(143): Xaa can be any naturally occurring amino acid
  misc_feature (146)..(146): Xaa can be any naturally occurring amino acid
  misc_feature (148)..(148): Xaa can be any naturally occurring amino acid
  misc_feature (153)..(162): Xaa can be any naturally occurring amino acid
  misc_feature (171)..(176): Xaa can be any naturally occurring amino acid
  misc_feature (178)..(179): Xaa can be any naturally occurring amino acid
  misc_feature (183)..(184): Xaa can be any naturally occurring amino acid
  misc_feature (188)..(188): Xaa can be any naturally occurring amino acid
  misc_feature (195)..(196): Xaa can be any naturally occurring amino acid
  misc_feature (207)..(207): Xaa can be any naturally occurring amino acid
  misc_feature (222)..(226): Xaa can be any naturally occurring amino acid
  misc_feature (228)..(228): Xaa can be any naturally occurring amino acid
  misc_feature (231)..(231): Xaa can be any naturally occurring amino acid
  misc_feature (236)..(237): Xaa can be any naturally occurring amino acid
  misc_feature (244)..(245): Xaa can be any naturally occurring amino acid
  misc_feature (258)..(259): Xaa can be any naturally occurring amino acid
  misc_feature (264)..(265): Xaa can be any naturally occurring amino acid
  misc_feature (267)..(267): Xaa can be any naturally occurring amino acid
  misc_feature (271)..(273): Xaa can be any naturally occurring amino acid
  misc_feature (275)..(276): Xaa can be any naturally occurring amino acid
  misc_feature (278)..(278): Xaa can be any naturally occurring amino acid
  misc_feature (281)..(285): Xaa can be any naturally occurring amino acid
  misc_feature (288)..(293): Xaa can be any naturally occurring amino acid
  misc_feature (295)..(295): Xaa can be any naturally occurring amino acid
  misc_feature (298)..(298): Xaa can be any naturally occurring amino acid
  misc_feature (310)..(310): Xaa can be any naturally occurring amino acid
  misc_feature (312)..(312): Xaa can be any naturally occurring amino acid
  misc_feature (314)..(314): Xaa can be any naturally occurring amino acid
  misc_feature (318)..(318): Xaa can be any naturally occurring amino acid
  misc_feature (320)..(320): Xaa can be any naturally occurring amino acid
  misc_feature (322)..(322): Xaa can be any naturally occurring amino acid
  misc_feature (325)..(326): Xaa can be any naturally occurring amino acid
  misc_feature (329)..(330): Xaa can be any naturally occurring amino acid
  misc_feature (332)..(333): Xaa can be any naturally occurring amino acid
  misc_feature (344)..(344): Xaa can be any naturally occurring amino acid
  misc_feature (347)..(351): Xaa can be any naturally occurring amino acid
  misc_feature (355)..(360): Xaa can be any naturally occurring amino acid
  misc_feature (362)..(362): Xaa can be any naturally occurring amino acid
  misc_feature (365)..(366): Xaa can be any naturally occurring amino acid
  misc_feature (368)..(370): Xaa can be any naturally occurring amino acid
  misc_feature (373)..(374): Xaa can be any naturally occurring amino acid
  misc_feature (378)..(378): Xaa can be any naturally occurring amino acid
  misc_feature (381)..(381): Xaa can be any naturally occurring amino acid
  misc_feature (386)..(387): Xaa can be any naturally occurring amino acid
  misc_feature (389)..(392): Xaa can be any naturally occurring amino acid
  misc_feature (394)..(395): Xaa can be any naturally occurring amino acid
  misc_feature (397)..(432): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXDSXKXLEADXXXXXXXXXXIQHANTLAXXXXXXRXXDGAXXQMRXSYSPAAXXFLFLVQWTDCXLAGALGLLRILIYKXXXXXYXDGXTTMSXXERKASIXXFYAVIFPSLLQLXXGITDXXDXKQKXXXCXXRXYRXXXXXDEXXXXXXSXIDXEREEECGICMEXNXKXVLPXCXHXMCXXCYXXWXXRSQSCPFCRDXLKXXXXXDLWXXXXXXDXVDXXTXXXENXXRLFXYIXKLPLXXPXXXXFXXYXXXXXXXXXXXXXXXXXXXXXXXXXXXXXXXXXXXX

SEQ ID NO: 67814 - protein, 913 aa, artificial
  consensus sequence
  misc_feature (1)..(69): Xaa can be any naturally occurring amino acid
  misc_feature (71)..(72): Xaa can be any naturally occurring amino acid
  misc_feature (75)..(76): Xaa can be any naturally occurring amino acid
  misc_feature (78)..(78): Xaa can be any naturally occurring amino acid
  misc_feature (80)..(85): Xaa can be any naturally occurring amino acid
  misc_feature (88)..(93): Xaa can be any naturally occurring amino acid
  misc_feature (95)..(99): Xaa can be any naturally occurring amino acid
  misc_feature (101)..(102): Xaa can be any naturally occurring amino acid
  misc_feature (104)..(109): Xaa can be any naturally occurring amino acid
  misc_feature (113)..(113): Xaa can be any naturally occurring amino acid
  misc_feature (115)..(115): Xaa can be any naturally occurring amino acid
  misc_feature (117)..(117): Xaa can be any naturally occurring amino acid
  misc_feature (120)..(123): Xaa can be any naturally occurring amino acid
  misc_feature (125)..(128): Xaa can be any naturally occurring amino acid
  misc_feature (130)..(132): Xaa can be any naturally occurring amino acid
  misc_feature (134)..(135): Xaa can be any naturally occurring amino acid
  misc_feature (137)..(139): Xaa can be any naturally occurring amino acid
  misc_feature (141)..(142): Xaa can be any naturally occurring amino acid
  misc_feature (146)..(148): Xaa can be any naturally occurring amino acid
  misc_feature (150)..(150): Xaa can be any naturally occurring amino acid
  misc_feature (152)..(156): Xaa can be any naturally occurring amino acid
  misc_feature (158)..(160): Xaa can be any naturally occurring amino acid
  misc_feature (163)..(165): Xaa can be any naturally occurring amino acid
  misc_feature (168)..(170): Xaa can be any naturally occurring amino acid
  misc_feature (173)..(174): Xaa can be any naturally occurring amino acid
  misc_feature (178)..(179): Xaa can be any naturally occurring amino acid
  misc_feature (182)..(182): Xaa can be any naturally occurring amino acid
  misc_feature (184)..(186): Xaa can be any naturally occurring amino acid
  misc_feature (188)..(201): Xaa can be any naturally occurring amino acid
  misc_feature (203)..(224): Xaa can be any naturally occurring amino acid
  misc_feature (226)..(250): Xaa can be any naturally occurring amino acid
  misc_feature (252)..(252): Xaa can be any naturally occurring amino acid
  misc_feature (254)..(274): Xaa can be any naturally occurring amino acid
  misc_feature (276)..(283): Xaa can be any naturally occurring amino acid
  misc_feature (285)..(287): Xaa can be any naturally occurring amino acid
  misc_feature (289)..(290): Xaa can be any naturally occurring amino acid
  misc_feature (292)..(304): Xaa can be any naturally occurring amino acid
  misc_feature (307)..(309): Xaa can be any naturally occurring amino acid
  misc_feature (311)..(314): Xaa can be any naturally occurring amino acid
  misc_feature (316)..(323): Xaa can be any naturally occurring amino acid
  misc_feature (325)..(326): Xaa can be any naturally occurring amino acid
  misc_feature (328)..(348): Xaa can be any naturally occurring amino acid
  misc_feature (350)..(353): Xaa can be any naturally occurring amino acid
  misc_feature (356)..(357): Xaa can be any naturally occurring amino acid
  misc_feature (359)..(359): Xaa can be any naturally occurring amino acid
  misc_feature (362)..(364): Xaa can be any naturally occurring amino acid
  misc_feature (367)..(368): Xaa can be any naturally occurring amino acid
  misc_feature (371)..(374): Xaa can be any naturally occurring amino acid
  misc_feature (377)..(393): Xaa can be any naturally occurring amino acid
  misc_feature (395)..(396): Xaa can be any naturally occurring amino acid
  misc_feature (398)..(398): Xaa can be any naturally occurring amino acid
  misc_feature (400)..(421): Xaa can be any naturally occurring amino acid
  misc_feature (423)..(423): Xaa can be any naturally occurring amino acid
  misc_feature (425)..(426): Xaa can be any naturally occurring amino acid
  misc_feature (428)..(428): Xaa can be any naturally occurring amino acid
  misc_feature (432)..(432): Xaa can be any naturally occurring amino acid
  misc_feature (435)..(436): Xaa can be any naturally occurring amino acid
  misc_feature (441)..(441): Xaa can be any naturally occurring amino acid
  misc_feature (443)..(444): Xaa can be any naturally occurring amino acid
  misc_feature (447)..(448): Xaa can be any naturally occurring amino acid
  misc_feature (450)..(453): Xaa can be any naturally occurring amino acid
  misc_feature (456)..(464): Xaa can be any naturally occurring amino acid
  misc_feature (467)..(467): Xaa can be any naturally occurring amino acid
  misc_feature (469)..(469): Xaa can be any naturally occurring amino acid
  misc_feature (474)..(477): Xaa can be any naturally occurring amino acid
  misc_feature (479)..(480): Xaa can be any naturally occurring amino acid
  misc_feature (483)..(486): Xaa can be any naturally occurring amino acid
  misc_feature (488)..(488): Xaa can be any naturally occurring amino acid
  misc_feature (490)..(492): Xaa can be any naturally occurring amino acid
  misc_feature (495)..(498): Xaa can be any naturally occurring amino acid
  misc_feature (500)..(501): Xaa can be any naturally occurring amino acid
  misc_feature (504)..(504): Xaa can be any naturally occurring amino acid
  misc_feature (506)..(507): Xaa can be any naturally occurring amino acid
  misc_feature (513)..(513): Xaa can be any naturally occurring amino acid
  misc_feature (515)..(516): Xaa can be any naturally occurring amino acid
  misc_feature (518)..(520): Xaa can be any naturally occurring amino acid
  misc_feature (526)..(526): Xaa can be any naturally occurring amino acid
  misc_feature (528)..(529): Xaa can be any naturally occurring amino acid
  misc_feature (531)..(541): Xaa can be any naturally occurring amino acid
  misc_feature (543)..(545): Xaa can be any naturally occurring amino acid
  misc_feature (548)..(913): Xaa can be any naturally occurring amino acid
XXXXXXXXXXXXXXXXXXXXXXXXXXXXXXXXXXXXXXXXXXXXXXXXXXXXXXXXXXXXXXXXXXXXXRXXPGXXGXPXXXXXXDRXXXXXXQXXXXXFXXRXXXXXXSTVXRXNXPPXXXXFXXXXPXXXAXXDXXXFXXLFDXXXVXKXXXXXGXXXPSXXXTGXXXRVXXYLDXXEPXHXXXKXXXXXXXXXXXXXXLXXXXXXXXXXXXXXXXXXXXXXEXXXXXXXXXXXXXXXXXXXXXXXXXFXFXXXXXXXXXXXXXXXXXXXXXGXXXXXXXXWXXXQXXPXXXXXXXXXXXXXEEXXXHXXXXPXXXXXXXXYXXLXXXXXXXXXXXXXXXXXXXXXGXXXXEAXXNXLFXXXFNXXGGXXXXLPXXXXXXXXXXXXXXXXXLXXEXRXXXXXXXXXXXXXXXXXXXXXXMXLXXSXVYEXLRXXPPVPXQXXRAXXDXXXXSHXXXXXXXXXGEXLXGYQPXXXXDXXVFXXXXEXFXXXRFXXXXGXXLLXYXXWSNGPXTXXPXXXNKQCAXKXXVXXXXXXXXXXXFXXXYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67815 - protein, 965 aa, artificial
  consensus sequence
  misc_feature (1)..(229): Xaa can be any naturally occurring amino acid
  misc_feature (231)..(231): Xaa can be any naturally occurring amino acid
  misc_feature (233)..(236): Xaa can be any naturally occurring amino acid
  misc_feature (238)..(238): Xaa can be any naturally occurring amino acid
  misc_feature (240)..(255): Xaa can be any naturally occurring amino acid
  misc_feature (257)..(270): Xaa can be any naturally occurring amino acid
  misc_feature (272)..(275): Xaa can be any naturally occurring amino acid
  misc_feature (277)..(289): Xaa can be any naturally occurring amino acid
  misc_feature (291)..(291): Xaa can be any naturally occurring amino acid
  misc_feature (293)..(335): Xaa can be any naturally occurring amino acid
  misc_feature (337)..(354): Xaa can be any naturally occurring amino acid
  misc_feature (356)..(359): Xaa can be any naturally occurring amino acid
  misc_feature (361)..(362): Xaa can be any naturally occurring amino acid
  misc_feature (364)..(368): Xaa can be any naturally occurring amino acid
  misc_feature (370)..(375): Xaa can be any naturally occurring amino acid
  misc_feature (377)..(378): Xaa can be any naturally occurring amino acid
  misc_feature (380)..(627): Xaa can be any naturally occurring amino acid
  misc_feature (629)..(630): Xaa can be any naturally occurring amino acid
  misc_feature (633)..(657): Xaa can be any naturally occurring amino acid
  misc_feature (659)..(663): Xaa can be any naturally occurring amino acid
  misc_feature (667)..(668): Xaa can be any naturally occurring amino acid
  misc_feature (670)..(965): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXAXXXXLXDXXXXXXXXXXXXXXXXSXXXXXXXXXXXXXXEXXXXLXXXXXXXXXXXXXEXYXXXXXXXXXXXXXXXXXXXXXXXXXXXXXXXXXXXXXXXXXXXLXXXXXXXXXXXXXXXXXXAXXXXRXXLXXXXXEXXXXXXEXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXVDXXXXXXXXXXXXXXXXXXXXXXXXXLXXXXXTIHXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67816 - protein, 579 aa, artificial
  consensus sequence
  misc_feature (1)..(124): Xaa can be any naturally occurring amino acid
  misc_feature (126)..(128): Xaa can be any naturally occurring amino acid
  misc_feature (132)..(132): Xaa can be any naturally occurring amino acid
  misc_feature (136)..(138): Xaa can be any naturally occurring amino acid
  misc_feature (140)..(140): Xaa can be any naturally occurring amino acid
  misc_feature (143)..(143): Xaa can be any naturally occurring amino acid
  misc_feature (146)..(146): Xaa can be any naturally occurring amino acid
  misc_feature (148)..(148): Xaa can be any naturally occurring amino acid
  misc_feature (152)..(157): Xaa can be any naturally occurring amino acid
  misc_feature (159)..(160): Xaa can be any naturally occurring amino acid
  misc_feature (162)..(162): Xaa can be any naturally occurring amino acid
  misc_feature (165)..(168): Xaa can be any naturally occurring amino acid
  misc_feature (173)..(173): Xaa can be any naturally occurring amino acid
  misc_feature (175)..(175): Xaa can be any naturally occurring amino acid
  misc_feature (177)..(181): Xaa can be any naturally occurring amino acid
  misc_feature (183)..(187): Xaa can be any naturally occurring amino acid
  misc_feature (189)..(192): Xaa can be any naturally occurring amino acid
  misc_feature (194)..(242): Xaa can be any naturally occurring amino acid
  misc_feature (244)..(248): Xaa can be any naturally occurring amino acid
  misc_feature (250)..(341): Xaa can be any naturally occurring amino acid
  misc_feature (343)..(438): Xaa can be any naturally occurring amino acid
  misc_feature (442)..(456): Xaa can be any naturally occurring amino acid
  misc_feature (458)..(459): Xaa can be any naturally occurring amino acid
  misc_feature (462)..(462): Xaa can be any naturally occurring amino acid
  misc_feature (468)..(468): Xaa can be any naturally occurring amino acid
  misc_feature (473)..(475): Xaa can be any naturally occurring amino acid
  misc_feature (477)..(486): Xaa can be any naturally occurring amino acid
  misc_feature (493)..(493): Xaa can be any naturally occurring amino acid
  misc_feature (495)..(498): Xaa can be any naturally occurring amino acid
  misc_feature (500)..(501): Xaa can be any naturally occurring amino acid
  misc_feature (503)..(528): Xaa can be any naturally occurring amino acid
  misc_feature (530)..(534): Xaa can be any naturally occurring amino acid
  misc_feature (536)..(536): Xaa can be any naturally occurring amino acid
  misc_feature (538)..(541): Xaa can be any naturally occurring amino acid
  misc_feature (548)..(550): Xaa can be any naturally occurring amino acid
  misc_feature (552)..(554): Xaa can be any naturally occurring amino acid
  misc_feature (556)..(576): Xaa can be any naturally occurring amino acid
  misc_feature (578)..(579): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXQPHXLKTXXXPXLDXGSXVXLLGXXXXXXLXXGXGKXXXXTDNLXKXSXXXXXWXXXXXGXXXXGXXXXXXXXXXXXXXXXXXXXXXXXXXXXXXXXXXXXXXXXXXXXXXXXXLXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSSXXXXXXXXXXXXXXXSXXETXYSAETXESRNXXXPXXXXXXXXXXVGRSQSXVXXXXWXXPXXXXXXXXXXXXXXXXXXXXXXXXXXQXXXXXQXSXXXXSPTVSSXXXKXXXSXXXXXXXXXXXXXXXXXXXXXWXX

SEQ ID NO: 67817 - protein, 214 aa, artificial
  consensus sequence
  misc_feature (1)..(1): Xaa can be any naturally occurring amino acid
  misc_feature (4)..(10): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (20)..(21): Xaa can be any naturally occurring amino acid
  misc_feature (23)..(24): Xaa can be any naturally occurring amino acid
  misc_feature (28)..(28): Xaa can be any naturally occurring amino acid
  misc_feature (32)..(32): Xaa can be any naturally occurring amino acid
  misc_feature (36)..(39): Xaa can be any naturally occurring amino acid
  misc_feature (42)..(42): Xaa can be any naturally occurring amino acid
  misc_feature (45)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(56): Xaa can be any naturally occurring amino acid
  misc_feature (59)..(59): Xaa can be any naturally occurring amino acid
  misc_feature (61)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (70)..(70): Xaa can be any naturally occurring amino acid
  misc_feature (73)..(73): Xaa can be any naturally occurring amino acid
  misc_feature (75)..(77): Xaa can be any naturally occurring amino acid
  misc_feature (80)..(82): Xaa can be any naturally occurring amino acid
  misc_feature (84)..(85): Xaa can be any naturally occurring amino acid
  misc_feature (88)..(88): Xaa can be any naturally occurring amino acid
  misc_feature (93)..(93): Xaa can be any naturally occurring amino acid
  misc_feature (95)..(97): Xaa can be any naturally occurring amino acid
  misc_feature (99)..(102): Xaa can be any naturally occurring amino acid
  misc_feature (105)..(107): Xaa can be any naturally occurring amino acid
  misc_feature (109)..(109): Xaa can be any naturally occurring amino acid
  misc_feature (111)..(111): Xaa can be any naturally occurring amino acid
  misc_feature (113)..(146): Xaa can be any naturally occurring amino acid
  misc_feature (149)..(151): Xaa can be any naturally occurring amino acid
  misc_feature (155)..(164): Xaa can be any naturally occurring amino acid
  misc_feature (166)..(168): Xaa can be any naturally occurring amino acid
  misc_feature (170)..(214): Xaa can be any naturally occurring amino acid
XMGXXXXXXXDAXVXLXSLXXAXXAPLXDAQXVLPXXXXPAXLVXXXRWXAXEFXXYLXAXPPXFXRGLXWLXLXXXWPXXXAXXYGXLARRXWXXXTXXXXGVXXXTXMXAXXXXXXXXXXXXXXXXXXXXXXXXXXXXXXXXXXKLXXXYVPXXXXXXXXXXAXXXGXXXXXXXXXXXXXXXXXXXXXXXXXXXXXXXXXXXXXXXXXXXXX

SEQ ID NO: 67818 - protein, 657 aa, artificial
  consensus sequence
  misc_feature (1)..(94): Xaa can be any naturally occurring amino acid
  misc_feature (97)..(97): Xaa can be any naturally occurring amino acid
  misc_feature (100)..(100): Xaa can be any naturally occurring amino acid
  misc_feature (102)..(107): Xaa can be any naturally occurring amino acid
  misc_feature (110)..(112): Xaa can be any naturally occurring amino acid
  misc_feature (115)..(116): Xaa can be any naturally occurring amino acid
  misc_feature (119)..(122): Xaa can be any naturally occurring amino acid
  misc_feature (124)..(125): Xaa can be any naturally occurring amino acid
  misc_feature (127)..(132): Xaa can be any naturally occurring amino acid
  misc_feature (136)..(136): Xaa can be any naturally occurring amino acid
  misc_feature (138)..(138): Xaa can be any naturally occurring amino acid
  misc_feature (140)..(140): Xaa can be any naturally occurring amino acid
  misc_feature (145)..(146): Xaa can be any naturally occurring amino acid
  misc_feature (148)..(151): Xaa can be any naturally occurring amino acid
  misc_feature (153)..(153): Xaa can be any naturally occurring amino acid
  misc_feature (156)..(157): Xaa can be any naturally occurring amino acid
  misc_feature (160)..(161): Xaa can be any naturally occurring amino acid
  misc_feature (164)..(165): Xaa can be any naturally occurring amino acid
  misc_feature (169)..(171): Xaa can be any naturally occurring amino acid
  misc_feature (173)..(173): Xaa can be any naturally occurring amino acid
  misc_feature (175)..(179): Xaa can be any naturally occurring amino acid
  misc_feature (182)..(182): Xaa can be any naturally occurring amino acid
  misc_feature (186)..(189): Xaa can be any naturally occurring amino acid
  misc_feature (192)..(193): Xaa can be any naturally occurring amino acid
  misc_feature (195)..(198): Xaa can be any naturally occurring amino acid
  misc_feature (201)..(202): Xaa can be any naturally occurring amino acid
  misc_feature (205)..(205): Xaa can be any naturally occurring amino acid
  misc_feature (207)..(209): Xaa can be any naturally occurring amino acid
  misc_feature (211)..(216): Xaa can be any naturally occurring amino acid
  misc_feature (218)..(225): Xaa can be any naturally occurring amino acid
  misc_feature (227)..(227): Xaa can be any naturally occurring amino acid
  misc_feature (229)..(240): Xaa can be any naturally occurring amino acid
  misc_feature (242)..(243): Xaa can be any naturally occurring amino acid
  misc_feature (245)..(253): Xaa can be any naturally occurring amino acid
  misc_feature (255)..(262): Xaa can be any naturally occurring amino acid
  misc_feature (264)..(264): Xaa can be any naturally occurring amino acid
  misc_feature (266)..(285): Xaa can be any naturally occurring amino acid
  misc_feature (287)..(289): Xaa can be any naturally occurring amino acid
  misc_feature (291)..(296): Xaa can be any naturally occurring amino acid
  misc_feature (298)..(300): Xaa can be any naturally occurring amino acid
  misc_feature (303)..(303): Xaa can be any naturally occurring amino acid
  misc_feature (305)..(313): Xaa can be any naturally occurring amino acid
  misc_feature (315)..(317): Xaa can be any naturally occurring amino acid
  misc_feature (319)..(322): Xaa can be any naturally occurring amino acid
  misc_feature (324)..(326): Xaa can be any naturally occurring amino acid
  misc_feature (329)..(330): Xaa can be any naturally occurring amino acid
  misc_feature (332)..(336): Xaa can be any naturally occurring amino acid
  misc_feature (338)..(340): Xaa can be any naturally occurring amino acid
  misc_feature (342)..(344): Xaa can be any naturally occurring amino acid
  misc_feature (346)..(361): Xaa can be any naturally occurring amino acid
  misc_feature (363)..(367): Xaa can be any naturally occurring amino acid
  misc_feature (369)..(369): Xaa can be any naturally occurring amino acid
  misc_feature (372)..(372): Xaa can be any naturally occurring amino acid
  misc_feature (376)..(376): Xaa can be any naturally occurring amino acid
  misc_feature (378)..(380): Xaa can be any naturally occurring amino acid
  misc_feature (383)..(384): Xaa can be any naturally occurring amino acid
  misc_feature (387)..(387): Xaa can be any naturally occurring amino acid
  misc_feature (389)..(391): Xaa can be any naturally occurring amino acid
  misc_feature (393)..(402): Xaa can be any naturally occurring amino acid
  misc_feature (404)..(405): Xaa can be any naturally occurring amino acid
  misc_feature (408)..(409): Xaa can be any naturally occurring amino acid
  misc_feature (412)..(412): Xaa can be any naturally occurring amino acid
  misc_feature (414)..(414): Xaa can be any naturally occurring amino acid
  misc_feature (416)..(429): Xaa can be any naturally occurring amino acid
  misc_feature (431)..(432): Xaa can be any naturally occurring amino acid
  misc_feature (434)..(437): Xaa can be any naturally occurring amino acid
  misc_feature (439)..(439): Xaa can be any naturally occurring amino acid
  misc_feature (441)..(441): Xaa can be any naturally occurring amino acid
  misc_feature (444)..(444): Xaa can be any naturally occurring amino acid
  misc_feature (446)..(446): Xaa can be any naturally occurring amino acid
  misc_feature (448)..(448): Xaa can be any naturally occurring amino acid
  misc_feature (451)..(452): Xaa can be any naturally occurring amino acid
  misc_feature (456)..(457): Xaa can be any naturally occurring amino acid
  misc_feature (461)..(461): Xaa can be any naturally occurring amino acid
  misc_feature (463)..(464): Xaa can be any naturally occurring amino acid
  misc_feature (466)..(469): Xaa can be any naturally occurring amino acid
  misc_feature (473)..(480): Xaa can be any naturally occurring amino acid
  misc_feature (483)..(483): Xaa can be any naturally occurring amino acid
  misc_feature (490)..(490): Xaa can be any naturally occurring amino acid
  misc_feature (493)..(493): Xaa can be any naturally occurring amino acid
  misc_feature (496)..(497): Xaa can be any naturally occurring amino acid
  misc_feature (499)..(504): Xaa can be any naturally occurring amino acid
  misc_feature (508)..(508): Xaa can be any naturally occurring amino acid
  misc_feature (512)..(512): Xaa can be any naturally occurring amino acid
  misc_feature (514)..(518): Xaa can be any naturally occurring amino acid
  misc_feature (520)..(521): Xaa can be any naturally occurring amino acid
  misc_feature (524)..(525): Xaa can be any naturally occurring amino acid
  misc_feature (527)..(527): Xaa can be any naturally occurring amino acid
  misc_feature (532)..(533): Xaa can be any naturally occurring amino acid
  misc_feature (536)..(537): Xaa can be any naturally occurring amino acid
  misc_feature (539)..(541): Xaa can be any naturally occurring amino acid
  misc_feature (546)..(546): Xaa can be any naturally occurring amino acid
  misc_feature (549)..(550): Xaa can be any naturally occurring amino acid
  misc_feature (554)..(555): Xaa can be any naturally occurring amino acid
  misc_feature (558)..(560): Xaa can be any naturally occurring amino acid
  misc_feature (562)..(562): Xaa can be any naturally occurring amino acid
  misc_feature (564)..(564): Xaa can be any naturally occurring amino acid
  misc_feature (566)..(566): Xaa can be any naturally occurring amino acid
  misc_feature (569)..(569): Xaa can be any naturally occurring amino acid
  misc_feature (571)..(641): Xaa can be any naturally occurring amino acid
  misc_feature (643)..(657): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPGXYGXPXXXXXXDRXXXFYXXQGXXXXFXXRXXXXXXSTVXRXNXPPGPXXFXXXXPXVVXXLDXXSFXXLFDXXXVXKXXXXXGTXMPSXXXXGGXXRXXXXLDXXEPXHXXXKXXXXXXLXXXXXXXXPXFXXXXXXXXXXXXEXXLXXXXXXXXXFXXXXXXXXFXFXXXXXXXXXXXXXXXXXXXXGXXXPXXXXXXWXXXQLXPXXXXXXXXXPXXXEXXXXHXXXLPXXLXXXXXYXXXLXXXFXXXXXXXXXXXXXXXXGXXXXXRXEAXHNLXFXXXFNXXGGXKXXXPXXXXXXXXXXGXXLHXXLAXEXRXXXXXXXXXXXXXXTXXAXXXXMXLXKSXVXEXLRXXPPVXXQYGXAXXDXXXXSHDXXXXXXXXGEXLFGYQPXATXDPXXFXXXXXXEFVXDRFXGXXXXXGXXLLXXVXWSNGXXETXXPXXXNKQCXGKXXVVLXXRLXXXEXFXRXYDXFXXXXXXXXXXXXXXXXXXXXXXXXXXXXXXXXXXXXXXXXXXXXXXXXXXXXXXXXXXXXXXXXXXXXXXXAXXXXXXXXXXXXXXX

SEQ ID NO: 67819 - protein, 764 aa, artificial
  consensus sequence
  misc_feature (1)..(83): Xaa can be any naturally occurring amino acid
  misc_feature (85)..(87): Xaa can be any naturally occurring amino acid
  misc_feature (89)..(91): Xaa can be any naturally occurring amino acid
  misc_feature (93)..(158): Xaa can be any naturally occurring amino acid
  misc_feature (160)..(164): Xaa can be any naturally occurring amino acid
  misc_feature (166)..(175): Xaa can be any naturally occurring amino acid
  misc_feature (177)..(197): Xaa can be any naturally occurring amino acid
  misc_feature (199)..(222): Xaa can be any naturally occurring amino acid
  misc_feature (224)..(245): Xaa can be any naturally occurring amino acid
  misc_feature (247)..(251): Xaa can be any naturally occurring amino acid
  misc_feature (253)..(253): Xaa can be any naturally occurring amino acid
  misc_feature (255)..(261): Xaa can be any naturally occurring amino acid
  misc_feature (263)..(327): Xaa can be any naturally occurring amino acid
  misc_feature (329)..(333): Xaa can be any naturally occurring amino acid
  misc_feature (337)..(346): Xaa can be any naturally occurring amino acid
  misc_feature (349)..(349): Xaa can be any naturally occurring amino acid
  misc_feature (351)..(352): Xaa can be any naturally occurring amino acid
  misc_feature (354)..(358): Xaa can be any naturally occurring amino acid
  misc_feature (360)..(363): Xaa can be any naturally occurring amino acid
  misc_feature (365)..(396): Xaa can be any naturally occurring amino acid
  misc_feature (398)..(457): Xaa can be any naturally occurring amino acid
  misc_feature (460)..(460): Xaa can be any naturally occurring amino acid
  misc_feature (462)..(464): Xaa can be any naturally occurring amino acid
  misc_feature (466)..(467): Xaa can be any naturally occurring amino acid
  misc_feature (469)..(475): Xaa can be any naturally occurring amino acid
  misc_feature (478)..(491): Xaa can be any naturally occurring amino acid
  misc_feature (493)..(494): Xaa can be any naturally occurring amino acid
  misc_feature (496)..(498): Xaa can be any naturally occurring amino acid
  misc_feature (503)..(521): Xaa can be any naturally occurring amino acid
  misc_feature (524)..(526): Xaa can be any naturally occurring amino acid
  misc_feature (529)..(532): Xaa can be any naturally occurring amino acid
  misc_feature (534)..(534): Xaa can be any naturally occurring amino acid
  misc_feature (536)..(540): Xaa can be any naturally occurring amino acid
  misc_feature (542)..(554): Xaa can be any naturally occurring amino acid
  misc_feature (556)..(556): Xaa can be any naturally occurring amino acid
  misc_feature (558)..(623): Xaa can be any naturally occurring amino acid
  misc_feature (625)..(637): Xaa can be any naturally occurring amino acid
  misc_feature (639)..(641): Xaa can be any naturally occurring amino acid
  misc_feature (643)..(644): Xaa can be any naturally occurring amino acid
  misc_feature (646)..(764): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXWXXXSXXXLXXXXXXXXXXXXXXXXXXXXXXXXXXXXXXXXXXXXXXXXXXXXXXXXXXXXXXXXXXXXXXXXXXRXXXXXLXXXXXXXXXXPXXXXXXXXXXXXXXXXXXXXXAXXXXXXXXXXXXXXXXXXXXXXXXDXXXXXXXXXXXXXXXXXXXXXXDXXXXXWXPXXXXXXXWXXXXXXXXXXXXXXXXXXXXXXXXXXXXXXXXXXXXXXXXXXXXXXXXXXXXXXXXXXXXXXXXXGXXXXXWSPXXXXXXXXXXLAXGXXDXXXXXLXXXXWXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXPKXGXXXLXXSXXXXXXXTRXXXXXXXXXXXXXXDXXPXXXWIWDXXXXXXXXXXXXXXXXXXXLVXXXPIXXXXWXPXXXXXLXXXXXXXXXXXXXYXWXXXXXXXXXXXXXXXXXXXXXXXXXXXXXXXXXXXXXXXXXXXXXXXXXXXXXXXXXXXXXXXXXXGXXXXXXXXXXXXXFXXXDXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67820 - protein, 227 aa, artificial
  consensus sequence
  misc_feature (1)..(2): Xaa can be any naturally occurring amino acid
  misc_feature (21)..(21): Xaa can be any naturally occurring amino acid
  misc_feature (23)..(26): Xaa can be any naturally occurring amino acid
  misc_feature (28)..(35): Xaa can be any naturally occurring amino acid
  misc_feature (37)..(37): Xaa can be any naturally occurring amino acid
  misc_feature (43)..(46): Xaa can be any naturally occurring amino acid
  misc_feature (48)..(50): Xaa can be any naturally occurring amino acid
  misc_feature (52)..(52): Xaa can be any naturally occurring amino acid
  misc_feature (54)..(54): Xaa can be any naturally occurring amino acid
  misc_feature (56)..(56): Xaa can be any naturally occurring amino acid
  misc_feature (58)..(58): Xaa can be any naturally occurring amino acid
  misc_feature (62)..(137): Xaa can be any naturally occurring amino acid
  misc_feature (139)..(139): Xaa can be any naturally occurring amino acid
  misc_feature (142)..(142): Xaa can be any naturally occurring amino acid
  misc_feature (148)..(148): Xaa can be any naturally occurring amino acid
  misc_feature (150)..(150): Xaa can be any naturally occurring amino acid
  misc_feature (153)..(153): Xaa can be any naturally occurring amino acid
  misc_feature (164)..(165): Xaa can be any naturally occurring amino acid
  misc_feature (167)..(167): Xaa can be any naturally occurring amino acid
  misc_feature (169)..(171): Xaa can be any naturally occurring amino acid
  misc_feature (173)..(179): Xaa can be any naturally occurring amino acid
  misc_feature (181)..(182): Xaa can be any naturally occurring amino acid
  misc_feature (184)..(185): Xaa can be any naturally occurring amino acid
  misc_feature (188)..(189): Xaa can be any naturally occurring amino acid
  misc_feature (192)..(195): Xaa can be any naturally occurring amino acid
  misc_feature (197)..(199): Xaa can be any naturally occurring amino acid
  misc_feature (202)..(215): Xaa can be any naturally occurring amino acid
  misc_feature (217)..(219): Xaa can be any naturally occurring amino acid
  misc_feature (221)..(221): Xaa can be any naturally occurring amino acid
  misc_feature (223)..(227): Xaa can be any naturally occurring amino acid
XXMRGVGGPLLTIGDLLSDLXVXXXXDXXXXXXXXSXPSSPSXXXXQXXXAXPXSXLXRLFXXXXXXXXXXXXXXXXXXXXXXXXXXXXXXXXXXXXXXXXXXXXXXXXXXXXXXXXXXXXXXXXXXXXXXXXXXXXEXYDXLMKALXEXDPXSWPSLMLKLCXXLXTXXXLXXXXXXXAXXLXXKVXXLEXXXXRXXXAVXXXXXXXXXXXXXXDXXXSXSXXXXX

SEQ ID NO: 67821 - protein, 99 aa, artificial
  consensus sequence
  misc_feature (2)..(5): Xaa can be any naturally occurring amino acid
  misc_feature (14)..(14): Xaa can be any naturally occurring amino acid
  misc_feature (22)..(22): Xaa can be any naturally occurring amino acid
  misc_feature (24)..(24): Xaa can be any naturally occurring amino acid
  misc_feature (30)..(30): Xaa can be any naturally occurring amino acid
  misc_feature (34)..(34): Xaa can be any naturally occurring amino acid
  misc_feature (39)..(39): Xaa can be any naturally occurring amino acid
  misc_feature (41)..(42): Xaa can be any naturally occurring amino acid
  misc_feature (44)..(44): Xaa can be any naturally occurring amino acid
  misc_feature (53)..(54): Xaa can be any naturally occurring amino acid
  misc_feature (56)..(56): Xaa can be any naturally occurring amino acid
  misc_feature (62)..(62): Xaa can be any naturally occurring amino acid
  misc_feature (64)..(64): Xaa can be any naturally occurring amino acid
  misc_feature (68)..(68): Xaa can be any naturally occurring amino acid
  misc_feature (71)..(71): Xaa can be any naturally occurring amino acid
  misc_feature (84)..(84): Xaa can be any naturally occurring amino acid
  misc_feature (87)..(87): Xaa can be any naturally occurring amino acid
  misc_feature (94)..(95): Xaa can be any naturally occurring amino acid
MXXXXRSLLLILLXISVSLSTXRXLPGEFXPVIXSGEIXPXXKXAVVGCGGEXXEXKTEYSXFXPEVXAGXFGSLVLNALPKGXRPXSGPSKKXXDVKT

SEQ ID NO: 67822 - protein, 210 aa, artificial
  consensus sequence
  misc_feature (1)..(10): Xaa can be any naturally occurring amino acid
  misc_feature (16)..(16): Xaa can be any naturally occurring amino acid
  misc_feature (19)..(19): Xaa can be any naturally occurring amino acid
  misc_feature (25)..(25): Xaa can be any naturally occurring amino acid
  misc_feature (27)..(27): Xaa can be any naturally occurring amino acid
  misc_feature (41)..(41): Xaa can be any naturally occurring amino acid
  misc_feature (43)..(43): Xaa can be any naturally occurring amino acid
  misc_feature (46)..(46): Xaa can be any naturally occurring amino acid
  misc_feature (48)..(48): Xaa can be any naturally occurring amino acid
  misc_feature (56)..(56): Xaa can be any naturally occurring amino acid
  misc_feature (74)..(74): Xaa can be any naturally occurring amino acid
  misc_feature (91)..(91): Xaa can be any naturally occurring amino acid
  misc_feature (96)..(97): Xaa can be any naturally occurring amino acid
  misc_feature (105)..(106): Xaa can be any naturally occurring amino acid
  misc_feature (109)..(109): Xaa can be any naturally occurring amino acid
  misc_feature (112)..(112): Xaa can be any naturally occurring amino acid
  misc_feature (125)..(125): Xaa can be any naturally occurring amino acid
  misc_feature (134)..(137): Xaa can be any naturally occurring amino acid
  misc_feature (142)..(145): Xaa can be any naturally occurring amino acid
  misc_feature (149)..(149): Xaa can be any naturally occurring amino acid
  misc_feature (152)..(210): Xaa can be any naturally occurring amino acid
XXXXXXXXXXVAVFAXCLXAVTAQXAXVLWWKRRFRRRSIXGXSEXDXFSSRGGDXTATPPPSKELLYFFLFCXENKQFRIGSATAPPLPXAAPPXXDVASKWSXXGEXLLXGPSETLFTIAEDXTSESDHRTXXXXPRGSXXXXDHVXDDXXXXXXXXXXXXXXXXXXXXXXXXXXXXXXXXXXXXXXXXXXXXXXXXXXXXXXXXXXX

SEQ ID NO: 67823 - protein, 625 aa, artificial
  consensus sequence
  misc_feature (1)..(67): Xaa can be any naturally occurring amino acid
  misc_feature (69)..(71): Xaa can be any naturally occurring amino acid
  misc_feature (73)..(75): Xaa can be any naturally occurring amino acid
  misc_feature (77)..(77): Xaa can be any naturally occurring amino acid
  misc_feature (80)..(83): Xaa can be any naturally occurring amino acid
  misc_feature (85)..(87): Xaa can be any naturally occurring amino acid
  misc_feature (89)..(131): Xaa can be any naturally occurring amino acid
  misc_feature (133)..(137): Xaa can be any naturally occurring amino acid
  misc_feature (141)..(142): Xaa can be any naturally occurring amino acid
  misc_feature (144)..(146): Xaa can be any naturally occurring amino acid
  misc_feature (148)..(157): Xaa can be any naturally occurring amino acid
  misc_feature (159)..(159): Xaa can be any naturally occurring amino acid
  misc_feature (162)..(163): Xaa can be any naturally occurring amino acid
  misc_feature (165)..(169): Xaa can be any naturally occurring amino acid
  misc_feature (172)..(174): Xaa can be any naturally occurring amino acid
  misc_feature (176)..(176): Xaa can be any naturally occurring amino acid
  misc_feature (181)..(183): Xaa can be any naturally occurring amino acid
  misc_feature (185)..(186): Xaa can be any naturally occurring amino acid
  misc_feature (188)..(188): Xaa can be any naturally occurring amino acid
  misc_feature (190)..(203): Xaa can be any naturally occurring amino acid
  misc_feature (205)..(206): Xaa can be any naturally occurring amino acid
  misc_feature (208)..(208): Xaa can be any naturally occurring amino acid
  misc_feature (210)..(214): Xaa can be any naturally occurring amino acid
  misc_feature (216)..(217): Xaa can be any naturally occurring amino acid
  misc_feature (219)..(221): Xaa can be any naturally occurring amino acid
  misc_feature (223)..(248): Xaa can be any naturally occurring amino acid
  misc_feature (250)..(256): Xaa can be any naturally occurring amino acid
  misc_feature (259)..(263): Xaa can be any naturally occurring amino acid
  misc_feature (265)..(272): Xaa can be any naturally occurring amino acid
  misc_feature (274)..(274): Xaa can be any naturally occurring amino acid
  misc_feature (276)..(351): Xaa can be any naturally occurring amino acid
  misc_feature (355)..(355): Xaa can be any naturally occurring amino acid
  misc_feature (358)..(361): Xaa can be any naturally occurring amino acid
  misc_feature (363)..(625): Xaa can be any naturally occurring amino acid
XXXXXXXXXXXXXXXXXXXXXXXXXXXXXXXXXXXXXXXXXXXXXXXXXXXXXXXXXXXXXXXXXXXDXXXRXXXDXEEXXXXAXXXEXXXXXXXXXXXXXXXXXXXXXXXXXXXXXXXXXXXXXXXXXXXDXXXXXGKTXXVXXXAXXXXXXXXXXGXYCXXCXXXXXKDXXXYXDHINXXXHXXAXGXXXXXXXXXXXXXXSXXVXRXXXXXVXXRXXXLXXXXXXXXXXXXXXXXXXXXXXXXXXRXXXXXXXEEXXXXXRXXXXXXXXKXKXXXXXXXXXXXXXXXXXXXXXXXXXXXXXXXXXXXXXXXXXXXXXXXXXXXXXXXXXXXXXXXXXXXXXXXXXXXXMGFXGFXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67824 - protein, 300 aa, artificial
  consensus sequence
  misc_feature (4)..(4): Xaa can be any naturally occurring amino acid
  misc_feature (11)..(12): Xaa can be any naturally occurring amino acid
  misc_feature (14)..(32): Xaa can be any naturally occurring amino acid
  misc_feature (35)..(37): Xaa can be any naturally occurring amino acid
  misc_feature (39)..(43): Xaa can be any naturally occurring amino acid
  misc_feature (47)..(47): Xaa can be any naturally occurring amino acid
  misc_feature (49)..(52): Xaa can be any naturally occurring amino acid
  misc_feature (54)..(57): Xaa can be any naturally occurring amino acid
  misc_feature (59)..(59): Xaa can be any naturally occurring amino acid
  misc_feature (61)..(69): Xaa can be any naturally occurring amino acid
  misc_feature (71)..(73): Xaa can be any naturally occurring amino acid
  misc_feature (75)..(75): Xaa can be any naturally occurring amino acid
  misc_feature (78)..(80): Xaa can be any naturally occurring amino acid
  misc_feature (82)..(110): Xaa can be any naturally occurring amino acid
  misc_feature (113)..(115): Xaa can be any naturally occurring amino acid
  misc_feature (117)..(117): Xaa can be any naturally occurring amino acid
  misc_feature (120)..(141): Xaa can be any naturally occurring amino acid
  misc_feature (143)..(143): Xaa can be any naturally occurring amino acid
  misc_feature (145)..(159): Xaa can be any naturally occurring amino acid
  misc_feature (162)..(167): Xaa can be any naturally occurring amino acid
  misc_feature (169)..(169): Xaa can be any naturally occurring amino acid
  misc_feature (171)..(172): Xaa can be any naturally occurring amino acid
  misc_feature (174)..(174): Xaa can be any naturally occurring amino acid
  misc_feature (190)..(191): Xaa can be any naturally occurring amino acid
  misc_feature (195)..(195): Xaa can be any naturally occurring amino acid
  misc_feature (197)..(198): Xaa can be any naturally occurring amino acid
  misc_feature (200)..(202): Xaa can be any naturally occurring amino acid
  misc_feature (204)..(206): Xaa can be any naturally occurring amino acid
  misc_feature (209)..(215): Xaa can be any naturally occurring amino acid
  misc_feature (217)..(218): Xaa can be any naturally occurring amino acid
  misc_feature (220)..(225): Xaa can be any naturally occurring amino acid
  misc_feature (230)..(230): Xaa can be any naturally occurring amino acid
  misc_feature (233)..(239): Xaa can be any naturally occurring amino acid
  misc_feature (241)..(241): Xaa can be any naturally occurring amino acid
  misc_feature (246)..(247): Xaa can be any naturally occurring amino acid
  misc_feature (249)..(249): Xaa can be any naturally occurring amino acid
  misc_feature (257)..(257): Xaa can be any naturally occurring amino acid
  misc_feature (264)..(264): Xaa can be any naturally occurring amino acid
  misc_feature (269)..(269): Xaa can be any naturally occurring amino acid
  misc_feature (272)..(272): Xaa can be any naturally occurring amino acid
  misc_feature (279)..(279): Xaa can be any naturally occurring amino acid
  misc_feature (284)..(284): Xaa can be any naturally occurring amino acid
  misc_feature (288)..(292): Xaa can be any naturally occurring amino acid
  misc_feature (295)..(300): Xaa can be any naturally occurring amino acid
MTPXTPPRSRXXRXXXXXXXXXXXXXXXXXXXTPXXXSXXXXXVTPXTXXXXKXXXXLXPXXXXXXXXXPXXXLXSPXXXPXXXXXXXXXXXXXXXXXXXXXXXXXXXXXLGXXXRXLFXXXXXXXXXXXXXXXXXXXXXXPXRXXXXXXXXXXXXXXXRDXXXXXXRXKXXKXVPGTPSDKVITFELAXXWNNXSXXNXXXSXXXEDXXXXXXXPXXVXXXXXXKNPFXSDXXXXXXXRXERKRXXLXENPDIEDXITYVNKXGEVVXKRXLTDEEKXRFKPXALFXXXXXEHXXXXXX

SEQ ID NO: 67825 - protein, 377 aa, artificial
  consensus sequence
  misc_feature (1)..(56): Xaa can be any naturally occurring amino acid
  misc_feature (58)..(105): Xaa can be any naturally occurring amino acid
  misc_feature (110)..(110): Xaa can be any naturally occurring amino acid
  misc_feature (114)..(114): Xaa can be any naturally occurring amino acid
  misc_feature (122)..(134): Xaa can be any naturally occurring amino acid
  misc_feature (139)..(170): Xaa can be any naturally occurring amino acid
  misc_feature (182)..(182): Xaa can be any naturally occurring amino acid
  misc_feature (186)..(199): Xaa can be any naturally occurring amino acid
  misc_feature (213)..(214): Xaa can be any naturally occurring amino acid
  misc_feature (216)..(216): Xaa can be any naturally occurring amino acid
  misc_feature (219)..(222): Xaa can be any naturally occurring amino acid
  misc_feature (225)..(238): Xaa can be any naturally occurring amino acid
  misc_feature (248)..(273): Xaa can be any naturally occurring amino acid
  misc_feature (280)..(316): Xaa can be any naturally occurring amino acid
  misc_feature (323)..(342): Xaa can be any naturally occurring amino acid
  misc_feature (344)..(344): Xaa can be any naturally occurring amino acid
  misc_feature (350)..(377): Xaa can be any naturally occurring amino acid
XXXXXXXXXXXXXXXXXXXXXXXXXXXXXXXXXXXXXXXXXXXXXXXXXXXXXXXXMXXXXXXXXXXXXXXXXXXXXXXXXXXXXXXXXXXXXXXXXXXXXXXXXKRFEXKKWXAVALWAWXXXXXXXXXXXXXDIVVXXXXXXXXXXXXXXXXXXXXXXXXXXXXXXXXCAICRNHIMDLXCIEXXXXXXXXXXXXXXCQANQASATSEECXXAXWGXXXXCNXXXXXXXXXXXXXXHAFHFHCISXXXXXXXXXXXXXXXXXXXXXXXXXXRWLKTRXXXXXXXXXXXXXXXXXXXXXXXXXXXXXXXXXXXXXVCPLDNXXXXXXXXXXXXXXXXXXXXWXFQKYGXXXXXXXXXXXXXXXXXXXXXXXXXXXX

SEQ ID NO: 67826 - protein, 1501 aa, artificial
  consensus sequence
  misc_feature (1)..(404): Xaa can be any naturally occurring amino acid
  misc_feature (406)..(415): Xaa can be any naturally occurring amino acid
  misc_feature (417)..(420): Xaa can be any naturally occurring amino acid
  misc_feature (422)..(436): Xaa can be any naturally occurring amino acid
  misc_feature (439)..(440): Xaa can be any naturally occurring amino acid
  misc_feature (443)..(445): Xaa can be any naturally occurring amino acid
  misc_feature (447)..(448): Xaa can be any naturally occurring amino acid
  misc_feature (451)..(453): Xaa can be any naturally occurring amino acid
  misc_feature (455)..(471): Xaa can be any naturally occurring amino acid
  misc_feature (473)..(474): Xaa can be any naturally occurring amino acid
  misc_feature (476)..(489): Xaa can be any naturally occurring amino acid
  misc_feature (491)..(510): Xaa can be any naturally occurring amino acid
  misc_feature (512)..(513): Xaa can be any naturally occurring amino acid
  misc_feature (515)..(517): Xaa can be any naturally occurring amino acid
  misc_feature (519)..(519): Xaa can be any naturally occurring amino acid
  misc_feature (521)..(521): Xaa can be any naturally occurring amino acid
  misc_feature (523)..(523): Xaa can be any naturally occurring amino acid
  misc_feature (525)..(525): Xaa can be any naturally occurring amino acid
  misc_feature (527)..(527): Xaa can be any naturally occurring amino acid
  misc_feature (529)..(529): Xaa can be any naturally occurring amino acid
  misc_feature (533)..(551): Xaa can be any naturally occurring amino acid
  misc_feature (556)..(580): Xaa can be any naturally occurring amino acid
  misc_feature (582)..(583): Xaa can be any naturally occurring amino acid
  misc_feature (585)..(585): Xaa can be any naturally occurring amino acid
  misc_feature (588)..(590): Xaa can be any naturally occurring amino acid
  misc_feature (593)..(593): Xaa can be any naturally occurring amino acid
  misc_feature (595)..(596): Xaa can be any naturally occurring amino acid
  misc_feature (600)..(600): Xaa can be any naturally occurring amino acid
  misc_feature (602)..(608): Xaa can be any naturally occurring amino acid
  misc_feature (610)..(614): Xaa can be any naturally occurring amino acid
  misc_feature (617)..(617): Xaa can be any naturally occurring amino acid
  misc_feature (620)..(624): Xaa can be any naturally occurring amino acid
  misc_feature (628)..(628): Xaa can be any naturally occurring amino acid
  misc_feature (631)..(638): Xaa can be any naturally occurring amino acid
  misc_feature (640)..(651): Xaa can be any naturally occurring amino acid
  misc_feature (653)..(655): Xaa can be any naturally occurring amino acid
  misc_feature (657)..(676): Xaa can be any naturally occurring amino acid
  misc_feature (678)..(684): Xaa can be any naturally occurring amino acid
  misc_feature (686)..(687): Xaa can be any naturally occurring amino acid
  misc_feature (690)..(692): Xaa can be any naturally occurring amino acid
  misc_feature (694)..(917): Xaa can be any naturally occurring amino acid
  misc_feature (919)..(919): Xaa can be any naturally occurring amino acid
  misc_feature (921)..(921): Xaa can be any naturally occurring amino acid
  misc_feature (923)..(1273): Xaa can be any naturally occurring amino acid
  misc_feature (1275)..(1275): Xaa can be any naturally occurring amino acid
  misc_feature (1277)..(1278): Xaa can be any naturally occurring amino acid
  misc_feature (1280)..(1281): Xaa can be any naturally occurring amino acid
  misc_feature (1284)..(1285): Xaa can be any naturally occurring amino acid
  misc_feature (1287)..(1501): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXIXXXXGXXXXXXXXXXXXXXXPIXXFSXXXIXXATXXXFXXXXXXXXXXXXXXXXXYXXGXXXXXXXXXXXXXXKXXXXXXXXXXXXXXXXXXXXIXXSXXXSXHXNXLXLXGXCLEXXXXXXXXXXXXXXXXXXXPVLVXXXXXXXXXXXXXXXXXXXXXXXXXWXXRXKIXXXIAXAXXYLHXAXXXXXXXRXXXXXNIXLDXXXXXAKLXDFXXXXXXXXGXXXXXXXXXXXXGXXXYXXXXXXXXXXXXXXXXXXXXYXXXXXXXEXXDVXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXLXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXMXXVXXELXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67827 - protein, 1055 aa, artificial
  consensus sequence
  misc_feature (1)..(94): Xaa can be any naturally occurring amino acid
  misc_feature (96)..(112): Xaa can be any naturally occurring amino acid
  misc_feature (114)..(114): Xaa can be any naturally occurring amino acid
  misc_feature (116)..(120): Xaa can be any naturally occurring amino acid
  misc_feature (123)..(155): Xaa can be any naturally occurring amino acid
  misc_feature (157)..(187): Xaa can be any naturally occurring amino acid
  misc_feature (189)..(210): Xaa can be any naturally occurring amino acid
  misc_feature (212)..(213): Xaa can be any naturally occurring amino acid
  misc_feature (215)..(216): Xaa can be any naturally occurring amino acid
  misc_feature (218)..(220): Xaa can be any naturally occurring amino acid
  misc_feature (222)..(241): Xaa can be any naturally occurring amino acid
  misc_feature (243)..(244): Xaa can be any naturally occurring amino acid
  misc_feature (246)..(246): Xaa can be any naturally occurring amino acid
  misc_feature (248)..(249): Xaa can be any naturally occurring amino acid
  misc_feature (254)..(263): Xaa can be any naturally occurring amino acid
  misc_feature (265)..(266): Xaa can be any naturally occurring amino acid
  misc_feature (269)..(283): Xaa can be any naturally occurring amino acid
  misc_feature (285)..(287): Xaa can be any naturally occurring amino acid
  misc_feature (289)..(291): Xaa can be any naturally occurring amino acid
  misc_feature (296)..(300): Xaa can be any naturally occurring amino acid
  misc_feature (302)..(305): Xaa can be any naturally occurring amino acid
  misc_feature (307)..(309): Xaa can be any naturally occurring amino acid
  misc_feature (311)..(312): Xaa can be any naturally occurring amino acid
  misc_feature (314)..(322): Xaa can be any naturally occurring amino acid
  misc_feature (325)..(325): Xaa can be any naturally occurring amino acid
  misc_feature (327)..(331): Xaa can be any naturally occurring amino acid
  misc_feature (333)..(333): Xaa can be any naturally occurring amino acid
  misc_feature (336)..(336): Xaa can be any naturally occurring amino acid
  misc_feature (343)..(347): Xaa can be any naturally occurring amino acid
  misc_feature (349)..(355): Xaa can be any naturally occurring amino acid
  misc_feature (357)..(359): Xaa can be any naturally occurring amino acid
  misc_feature (361)..(361): Xaa can be any naturally occurring amino acid
  misc_feature (363)..(364): Xaa can be any naturally occurring amino acid
  misc_feature (369)..(375): Xaa can be any naturally occurring amino acid
  misc_feature (377)..(377): Xaa can be any naturally occurring amino acid
  misc_feature (379)..(379): Xaa can be any naturally occurring amino acid
  misc_feature (381)..(382): Xaa can be any naturally occurring amino acid
  misc_feature (384)..(415): Xaa can be any naturally occurring amino acid
  misc_feature (417)..(420): Xaa can be any naturally occurring amino acid
  misc_feature (422)..(441): Xaa can be any naturally occurring amino acid
  misc_feature (443)..(1055): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXLXEXXXXXGRXXXXXXXXXXXXXXXXXXXXXXXXXXXXXXXXXDXXXXXXXXXXXXXXXXXXXXXXXXXXXXXXXRXXXXXXXXXXXXXXXXXXXXXXLXXRXXRXXXGXXXXXXXXXXXXXXXXXXXXLXXGXPXXGKTTXXXXXXXXXXRXXARXXXXXXXXXXXXXXXVXXXDXXXEIAGXXXXXPXXXXGXXXRXXVXXXXXXXXXMIXAXXXXXPXVIXIDEIGTXXXXXAXXXXXXXGXXXVXLXXTAHGXXXXXXXKXPXLXXLXXXXXXXXXXXXXXXXXXXXXXXXXXXXXXXXFXXXXEXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67828 - protein, 762 aa, artificial
  consensus sequence
  misc_feature (1)..(87): Xaa can be any naturally occurring amino acid
  misc_feature (90)..(106): Xaa can be any naturally occurring amino acid
  misc_feature (108)..(108): Xaa can be any naturally occurring amino acid
  misc_feature (110)..(114): Xaa can be any naturally occurring amino acid
  misc_feature (117)..(181): Xaa can be any naturally occurring amino acid
  misc_feature (183)..(183): Xaa can be any naturally occurring amino acid
  misc_feature (185)..(204): Xaa can be any naturally occurring amino acid
  misc_feature (206)..(208): Xaa can be any naturally occurring amino acid
  misc_feature (210)..(211): Xaa can be any naturally occurring amino acid
  misc_feature (213)..(215): Xaa can be any naturally occurring amino acid
  misc_feature (217)..(236): Xaa can be any naturally occurring amino acid
  misc_feature (238)..(239): Xaa can be any naturally occurring amino acid
  misc_feature (241)..(241): Xaa can be any naturally occurring amino acid
  misc_feature (243)..(244): Xaa can be any naturally occurring amino acid
  misc_feature (249)..(250): Xaa can be any naturally occurring amino acid
  misc_feature (252)..(253): Xaa can be any naturally occurring amino acid
  misc_feature (256)..(270): Xaa can be any naturally occurring amino acid
  misc_feature (272)..(272): Xaa can be any naturally occurring amino acid
  misc_feature (274)..(274): Xaa can be any naturally occurring amino acid
  misc_feature (276)..(278): Xaa can be any naturally occurring amino acid
  misc_feature (283)..(287): Xaa can be any naturally occurring amino acid
  misc_feature (289)..(292): Xaa can be any naturally occurring amino acid
  misc_feature (294)..(296): Xaa can be any naturally occurring amino acid
  misc_feature (298)..(299): Xaa can be any naturally occurring amino acid
  misc_feature (301)..(309): Xaa can be any naturally occurring amino acid
  misc_feature (311)..(312): Xaa can be any naturally occurring amino acid
  misc_feature (314)..(318): Xaa can be any naturally occurring amino acid
  misc_feature (320)..(320): Xaa can be any naturally occurring amino acid
  misc_feature (323)..(324): Xaa can be any naturally occurring amino acid
  misc_feature (330)..(334): Xaa can be any naturally occurring amino acid
  misc_feature (336)..(342): Xaa can be any naturally occurring amino acid
  misc_feature (345)..(345): Xaa can be any naturally occurring amino acid
  misc_feature (347)..(348): Xaa can be any naturally occurring amino acid
  misc_feature (353)..(357): Xaa can be any naturally occurring amino acid
  misc_feature (359)..(361): Xaa can be any naturally occurring amino acid
  misc_feature (363)..(363): Xaa can be any naturally occurring amino acid
  misc_feature (365)..(366): Xaa can be any naturally occurring amino acid
  misc_feature (368)..(399): Xaa can be any naturally occurring amino acid
  misc_feature (401)..(404): Xaa can be any naturally occurring amino acid
  misc_feature (406)..(425): Xaa can be any naturally occurring amino acid
  misc_feature (427)..(762): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXLPXXXXXXXXXXXXXXXXXLXEXXXXXGRXXXXXXXXXXXXXXXXXXXXXXXXXXXXXXXXXXXXXXXXXXXXXXXXXXXXXXXXXXXXXXXXXRXGXXXXXXXXXXXXXXXXXXXXLXXXRXXRXXXGXXXXXXXXXXXXXXXXXXXXLXXGXPXXGKTTXXRXXARXXXXXXXXXXXXXXXVXIXDXXXEIAGXXXXXPXXXXGXXXRXXVXXXXXXXXXMXXAXXXXXPXVIXXDEIGTXXXXXAXXXXXXXGVXLXXTAHGXXXXXLXXXPXLXXLXXXXXXXXXXXXXXXXXXXXXXXXXXXXXXXXFXXXXEXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67829 - protein, 2228 aa, artificial
  consensus sequence
  misc_feature (1)..(1566): Xaa can be any naturally occurring amino acid
  misc_feature (1568)..(1595): Xaa can be any naturally occurring amino acid
  misc_feature (1597)..(1848): Xaa can be any naturally occurring amino acid
  misc_feature (1850)..(1896): Xaa can be any naturally occurring amino acid
  misc_feature (1898)..(1898): Xaa can be any naturally occurring amino acid
  misc_feature (1901)..(1902): Xaa can be any naturally occurring amino acid
  misc_feature (1904)..(1936): Xaa can be any naturally occurring amino acid
  misc_feature (1940)..(1941): Xaa can be any naturally occurring amino acid
  misc_feature (1944)..(1944): Xaa can be any naturally occurring amino acid
  misc_feature (1946)..(1951): Xaa can be any naturally occurring amino acid
  misc_feature (1953)..(1966): Xaa can be any naturally occurring amino acid
  misc_feature (1969)..(1972): Xaa can be any naturally occurring amino acid
  misc_feature (1974)..(1974): Xaa can be any naturally occurring amino acid
  misc_feature (1976)..(1997): Xaa can be any naturally occurring amino acid
  misc_feature (1999)..(2001): Xaa can be any naturally occurring amino acid
  misc_feature (2003)..(2228): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXIXPYXXQXXXXXXXXXXXXXXXXXXXXXXXXXXXXXXXXXTVDXXQGXEXXXXXXSXXXXXXXXXXXXXXFLXXXXRXNXXXXXXXXXXXXXXXXXXXXXXVXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67830 - protein, 263 aa, artificial
  consensus sequence
  misc_feature (1)..(59): Xaa can be any naturally occurring amino acid
  misc_feature (62)..(62): Xaa can be any naturally occurring amino acid
  misc_feature (64)..(66): Xaa can be any naturally occurring amino acid
  misc_feature (68)..(71): Xaa can be any naturally occurring amino acid
  misc_feature (73)..(73): Xaa can be any naturally occurring amino acid
  misc_feature (75)..(84): Xaa can be any naturally occurring amino acid
  misc_feature (87)..(87): Xaa can be any naturally occurring amino acid
  misc_feature (91)..(91): Xaa can be any naturally occurring amino acid
  misc_feature (93)..(93): Xaa can be any naturally occurring amino acid
  misc_feature (98)..(118): Xaa can be any naturally occurring amino acid
  misc_feature (121)..(121): Xaa can be any naturally occurring amino acid
  misc_feature (124)..(124): Xaa can be any naturally occurring amino acid
  misc_feature (138)..(174): Xaa can be any naturally occurring amino acid
  misc_feature (178)..(178): Xaa can be any naturally occurring amino acid
  misc_feature (180)..(216): Xaa can be any naturally occurring amino acid
  misc_feature (218)..(239): Xaa can be any naturally occurring amino acid
  misc_feature (241)..(241): Xaa can be any naturally occurring amino acid
  misc_feature (243)..(263): Xaa can be any naturally occurring amino acid
XXXXXXXXXXXXXXXXXXXXXXXXXXXXXXXXXXXXXXXXXXXXXXXXXXXXXXXXXXXKRXRXXXLXXXXDXDXXXXXXXXXXDLXSVMXSXEEEIXXXXXXXXXXXXXXXXXXXXXQPXLGXLLEASDDELGLPPXXXXXXXXXXXXXXXXXXXXXXXXXXXXXXXXXXXXXFEDXIXXXXXXXXXXXXXXXXXXXXXXXXXXXXXXXXXXXXXFXXXXXXXXXXXXXXXXXXXXXXRXEXXXXXXXXXXXXXXXXXXXXX

SEQ ID NO: 67831 - protein, 148 aa, artificial
  consensus sequence
  misc_feature (1)..(60): Xaa can be any naturally occurring amino acid
  misc_feature (63)..(65): Xaa can be any naturally occurring amino acid
  misc_feature (71)..(71): Xaa can be any naturally occurring amino acid
  misc_feature (73)..(74): Xaa can be any naturally occurring amino acid
  misc_feature (77)..(78): Xaa can be any naturally occurring amino acid
  misc_feature (87)..(92): Xaa can be any naturally occurring amino acid
  misc_feature (94)..(99): Xaa can be any naturally occurring amino acid
  misc_feature (101)..(101): Xaa can be any naturally occurring amino acid
  misc_feature (103)..(124): Xaa can be any naturally occurring amino acid
  misc_feature (126)..(148): Xaa can be any naturally occurring amino acid
XXXXXXXXXXXXXXXXXXXXXXXXXXXXXXXXXXXXXXXXXXXXXXXXXXXXXXXXXXXXEDXXXGIICYXDXXGEXXCEGYDEGPXXXXXXPXXXXXXRXVXXXXXXXXXXXXXXXXXXXXXXDXXXXXXXXXXXXXXXXXXXXXXX

SEQ ID NO: 67832 - protein, 402 aa, artificial
  consensus sequence
  misc_feature (3)..(7): Xaa can be any naturally occurring amino acid
  misc_feature (9)..(10): Xaa can be any naturally occurring amino acid
  misc_feature (12)..(13): Xaa can be any naturally occurring amino acid
  misc_feature (15)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (27)..(31): Xaa can be any naturally occurring amino acid
  misc_feature (34)..(38): Xaa can be any naturally occurring amino acid
  misc_feature (40)..(75): Xaa can be any naturally occurring amino acid
  misc_feature (77)..(79): Xaa can be any naturally occurring amino acid
  misc_feature (81)..(81): Xaa can be any naturally occurring amino acid
  misc_feature (84)..(84): Xaa can be any naturally occurring amino acid
  misc_feature (86)..(89): Xaa can be any naturally occurring amino acid
  misc_feature (91)..(91): Xaa can be any naturally occurring amino acid
  misc_feature (94)..(108): Xaa can be any naturally occurring amino acid
  misc_feature (110)..(112): Xaa can be any naturally occurring amino acid
  misc_feature (114)..(116): Xaa can be any naturally occurring amino acid
  misc_feature (118)..(120): Xaa can be any naturally occurring amino acid
  misc_feature (123)..(126): Xaa can be any naturally occurring amino acid
  misc_feature (128)..(134): Xaa can be any naturally occurring amino acid
  misc_feature (136)..(138): Xaa can be any naturally occurring amino acid
  misc_feature (142)..(143): Xaa can be any naturally occurring amino acid
  misc_feature (147)..(147): Xaa can be any naturally occurring amino acid
  misc_feature (164)..(164): Xaa can be any naturally occurring amino acid
  misc_feature (167)..(170): Xaa can be any naturally occurring amino acid
  misc_feature (172)..(172): Xaa can be any naturally occurring amino acid
  misc_feature (174)..(174): Xaa can be any naturally occurring amino acid
  misc_feature (178)..(201): Xaa can be any naturally occurring amino acid
  misc_feature (203)..(206): Xaa can be any naturally occurring amino acid
  misc_feature (208)..(217): Xaa can be any naturally occurring amino acid
  misc_feature (220)..(224): Xaa can be any naturally occurring amino acid
  misc_feature (228)..(236): Xaa can be any naturally occurring amino acid
  misc_feature (238)..(267): Xaa can be any naturally occurring amino acid
  misc_feature (269)..(272): Xaa can be any naturally occurring amino acid
  misc_feature (275)..(278): Xaa can be any naturally occurring amino acid
  misc_feature (280)..(284): Xaa can be any naturally occurring amino acid
  misc_feature (286)..(290): Xaa can be any naturally occurring amino acid
  misc_feature (293)..(305): Xaa can be any naturally occurring amino acid
  misc_feature (307)..(307): Xaa can be any naturally occurring amino acid
  misc_feature (309)..(321): Xaa can be any naturally occurring amino acid
  misc_feature (323)..(325): Xaa can be any naturally occurring amino acid
  misc_feature (329)..(330): Xaa can be any naturally occurring amino acid
  misc_feature (335)..(335): Xaa can be any naturally occurring amino acid
  misc_feature (337)..(341): Xaa can be any naturally occurring amino acid
  misc_feature (343)..(349): Xaa can be any naturally occurring amino acid
  misc_feature (352)..(354): Xaa can be any naturally occurring amino acid
  misc_feature (357)..(361): Xaa can be any naturally occurring amino acid
  misc_feature (363)..(366): Xaa can be any naturally occurring amino acid
  misc_feature (368)..(370): Xaa can be any naturally occurring amino acid
  misc_feature (372)..(373): Xaa can be any naturally occurring amino acid
  misc_feature (376)..(376): Xaa can be any naturally occurring amino acid
  misc_feature (378)..(382): Xaa can be any naturally occurring amino acid
  misc_feature (384)..(385): Xaa can be any naturally occurring amino acid
  misc_feature (387)..(388): Xaa can be any naturally occurring amino acid
  misc_feature (390)..(392): Xaa can be any naturally occurring amino acid
  misc_feature (394)..(395): Xaa can be any naturally occurring amino acid
  misc_feature (397)..(397): Xaa can be any naturally occurring amino acid
  misc_feature (400)..(402): Xaa can be any naturally occurring amino acid
MEXXXXXSXXKXXPXXXXXXXNXKXSXXXXXKHXXXXXLXXXXXXXXXXXXXXXXXXXXXXXXXXXXXXXXXXXXPXXXCXISXSXXXXSXNPXXXXXXXXXXXXXXXKXXXLXXXPXXXVKXXXXLXXXXXXXKXXXTLVXXPFFXWMYFSWTWLFWPWFIAXGLXXXXGXYXFRKXXXXXXXXXXXXXXXXXXXXXXXXVXXXXFXXXXXXXXXXFFXXXXXFFFXXXXXXXXXYXXXXXXXXXXXXXXXXXXXXXXXXXXXXXXGXXXXAFXXXXLXXXXXGXXXXXIWXXXXXXXXXXXXXTXYXXXXXXXXXXXXXVXXXGPYXXVRHPXYXXXXXLXXXXXXXLRXXXSLXXXXXVXXXXYXXXAXXEEXLXXXXXGXXYXXYXXXVXXKXIPXXX

SEQ ID NO: 67833 - protein, 386 aa, artificial
  consensus sequence
  misc_feature (1)..(24): Xaa can be any naturally occurring amino acid
  misc_feature (26)..(31): Xaa can be any naturally occurring amino acid
  misc_feature (33)..(64): Xaa can be any naturally occurring amino acid
  misc_feature (67)..(72): Xaa can be any naturally occurring amino acid
  misc_feature (74)..(109): Xaa can be any naturally occurring amino acid
  misc_feature (111)..(111): Xaa can be any naturally occurring amino acid
  misc_feature (113)..(167): Xaa can be any naturally occurring amino acid
  misc_feature (169)..(170): Xaa can be any naturally occurring amino acid
  misc_feature (172)..(189): Xaa can be any naturally occurring amino acid
  misc_feature (191)..(255): Xaa can be any naturally occurring amino acid
  misc_feature (257)..(257): Xaa can be any naturally occurring amino acid
  misc_feature (259)..(259): Xaa can be any naturally occurring amino acid
  misc_feature (266)..(266): Xaa can be any naturally occurring amino acid
  misc_feature (270)..(271): Xaa can be any naturally occurring amino acid
  misc_feature (275)..(278): Xaa can be any naturally occurring amino acid
  misc_feature (280)..(285): Xaa can be any naturally occurring amino acid
  misc_feature (287)..(290): Xaa can be any naturally occurring amino acid
  misc_feature (292)..(292): Xaa can be any naturally occurring amino acid
  misc_feature (295)..(295): Xaa can be any naturally occurring amino acid
  misc_feature (297)..(298): Xaa can be any naturally occurring amino acid
  misc_feature (300)..(300): Xaa can be any naturally occurring amino acid
  misc_feature (303)..(303): Xaa can be any naturally occurring amino acid
  misc_feature (305)..(305): Xaa can be any naturally occurring amino acid
  misc_feature (307)..(308): Xaa can be any naturally occurring amino acid
  misc_feature (310)..(316): Xaa can be any naturally occurring amino acid
  misc_feature (318)..(319): Xaa can be any naturally occurring amino acid
  misc_feature (321)..(321): Xaa can be any naturally occurring amino acid
  misc_feature (329)..(337): Xaa can be any naturally occurring amino acid
  misc_feature (341)..(341): Xaa can be any naturally occurring amino acid
  misc_feature (343)..(344): Xaa can be any naturally occurring amino acid
  misc_feature (346)..(351): Xaa can be any naturally occurring amino acid
  misc_feature (353)..(355): Xaa can be any naturally occurring amino acid
  misc_feature (359)..(359): Xaa can be any naturally occurring amino acid
  misc_feature (363)..(363): Xaa can be any naturally occurring amino acid
  misc_feature (365)..(365): Xaa can be any naturally occurring amino acid
  misc_feature (367)..(369): Xaa can be any naturally occurring amino acid
  misc_feature (371)..(386): Xaa can be any naturally occurring amino acid
XXXXXXXXXXXXXXXXXXXXXXXXGXXXXXXSXXXXXXXXXXXXXXXXXXXXXXXXXXXXXXXXSEXXXXXXPXXXXXXXXXXXXXXXXXXXXXXXXXXXXXXXXXXXXPXKXXXXXXXXXXXXXXXXXXXXXXXXXXXXXXXXXXXXXXXXXXXXXXXXXXXXXXXDXXGXXXXXXXXXXXXXXXXXXLXXXXXXXXXXXXXXXXXXXXXXXXXXXXXXXXXXXXXXXXXXXXXXXXXXXXXXXXXXXXXXXXXRXRXQRIADNXKALXXLLPXXXXGXXXXXXLXXXXDXVKXLXXQXKEXSXSXXLXXXXXXXPXXFXEGYGHYIXXXXXXXXXLEEXMXXLXXXXXXAXXXLLEXKGLXLXPXXXVXXXXXXXXXXXXXXXX

SEQ ID NO: 67834 - protein, 531 aa, artificial
  consensus sequence
  misc_feature (1)..(163): Xaa can be any naturally occurring amino acid
  misc_feature (165)..(167): Xaa can be any naturally occurring amino acid
  misc_feature (169)..(194): Xaa can be any naturally occurring amino acid
  misc_feature (197)..(201): Xaa can be any naturally occurring amino acid
  misc_feature (203)..(204): Xaa can be any naturally occurring amino acid
  misc_feature (206)..(211): Xaa can be any naturally occurring amino acid
  misc_feature (213)..(213): Xaa can be any naturally occurring amino acid
  misc_feature (216)..(217): Xaa can be any naturally occurring amino acid
  misc_feature (219)..(241): Xaa can be any naturally occurring amino acid
  misc_feature (243)..(245): Xaa can be any naturally occurring amino acid
  misc_feature (247)..(248): Xaa can be any naturally occurring amino acid
  misc_feature (250)..(283): Xaa can be any naturally occurring amino acid
  misc_feature (288)..(288): Xaa can be any naturally occurring amino acid
  misc_feature (290)..(291): Xaa can be any naturally occurring amino acid
  misc_feature (293)..(293): Xaa can be any naturally occurring amino acid
  misc_feature (295)..(296): Xaa can be any naturally occurring amino acid
  misc_feature (298)..(298): Xaa can be any naturally occurring amino acid
  misc_feature (301)..(311): Xaa can be any naturally occurring amino acid
  misc_feature (313)..(315): Xaa can be any naturally occurring amino acid
  misc_feature (317)..(317): Xaa can be any naturally occurring amino acid
  misc_feature (319)..(320): Xaa can be any naturally occurring amino acid
  misc_feature (322)..(324): Xaa can be any naturally occurring amino acid
  misc_feature (330)..(333): Xaa can be any naturally occurring amino acid
  misc_feature (338)..(339): Xaa can be any naturally occurring amino acid
  misc_feature (341)..(341): Xaa can be any naturally occurring amino acid
  misc_feature (344)..(531): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXAXXXXXXXXXXXXXXXXXXXXXXXXXXSLXXXXXRXXTXXXXXXAXPAXXLXXXXXXXXXXXXXXXXXXXXXXXMXXXFXXEXXXXXXXXXXXXXXXXXXXXXXXXXXXXXXXXXXLLRVXFXXEXDXXLXEVXXXXXXXXXXXGXXXDXEXXAXXXKQQEKXXXXRQVEXXLXLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67835 - protein, 1061 aa, artificial
  consensus sequence
  misc_feature (1)..(92): Xaa can be any naturally occurring amino acid
  misc_feature (94)..(126): Xaa can be any naturally occurring amino acid
  misc_feature (131)..(131): Xaa can be any naturally occurring amino acid
  misc_feature (133)..(133): Xaa can be any naturally occurring amino acid
  misc_feature (137)..(141): Xaa can be any naturally occurring amino acid
  misc_feature (143)..(155): Xaa can be any naturally occurring amino acid
  misc_feature (157)..(162): Xaa can be any naturally occurring amino acid
  misc_feature (166)..(167): Xaa can be any naturally occurring amino acid
  misc_feature (170)..(172): Xaa can be any naturally occurring amino acid
  misc_feature (175)..(176): Xaa can be any naturally occurring amino acid
  misc_feature (178)..(179): Xaa can be any naturally occurring amino acid
  misc_feature (182)..(182): Xaa can be any naturally occurring amino acid
  misc_feature (184)..(201): Xaa can be any naturally occurring amino acid
  misc_feature (206)..(233): Xaa can be any naturally occurring amino acid
  misc_feature (236)..(242): Xaa can be any naturally occurring amino acid
  misc_feature (244)..(323): Xaa can be any naturally occurring amino acid
  misc_feature (326)..(369): Xaa can be any naturally occurring amino acid
  misc_feature (371)..(371): Xaa can be any naturally occurring amino acid
  misc_feature (373)..(374): Xaa can be any naturally occurring amino acid
  misc_feature (377)..(457): Xaa can be any naturally occurring amino acid
  misc_feature (460)..(460): Xaa can be any naturally occurring amino acid
  misc_feature (462)..(1061): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXVAPFXGXLKSXXXXXPXXXXXXXXXXXXXSXXXXXXGGRXXCMXXXWPXXGXXKKXEXXXXXXXXXXXXXXXXXXTLSYXXXXXXXXXXXXXXXXXXXXXXXXXXXXLPXXXXXXXLXXXXXXXXXXXXXXXXXXXXXXXXXXXXXXXXXXXXXXXXXXXXXXXXXXXXXXXXXXXXXXXXXXXXXXXXXXXXXXXXYLXXXXXXXXXXXXXXXXXXXXXXXXXXXXXXXXXXXXXXXXXXXXWXPXXCLXXXXXXXXXXXXXXXXXXXXXXXXXXXXXXXXXXXXXXXXXXXXXXXXXXXXXXXXXXXXXXXXXXXXXXXXXXXXXXXXXYYXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67836 - protein, 405 aa, artificial
  consensus sequence
  misc_feature (1)..(151): Xaa can be any naturally occurring amino acid
  misc_feature (156)..(156): Xaa can be any naturally occurring amino acid
  misc_feature (160)..(160): Xaa can be any naturally occurring amino acid
  misc_feature (170)..(170): Xaa can be any naturally occurring amino acid
  misc_feature (174)..(180): Xaa can be any naturally occurring amino acid
  misc_feature (182)..(204): Xaa can be any naturally occurring amino acid
  misc_feature (216)..(226): Xaa can be any naturally occurring amino acid
  misc_feature (234)..(234): Xaa can be any naturally occurring amino acid
  misc_feature (236)..(236): Xaa can be any naturally occurring amino acid
  misc_feature (238)..(239): Xaa can be any naturally occurring amino acid
  misc_feature (241)..(245): Xaa can be any naturally occurring amino acid
  misc_feature (247)..(248): Xaa can be any naturally occurring amino acid
  misc_feature (252)..(256): Xaa can be any naturally occurring amino acid
  misc_feature (262)..(262): Xaa can be any naturally occurring amino acid
  misc_feature (266)..(266): Xaa can be any naturally occurring amino acid
  misc_feature (271)..(271): Xaa can be any naturally occurring amino acid
  misc_feature (273)..(277): Xaa can be any naturally occurring amino acid
  misc_feature (280)..(368): Xaa can be any naturally occurring amino acid
  misc_feature (370)..(405): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRFEXKKWXAVALWAWDIXVDNXXXXXXXCXXXXXXXXXXXXXXXXXXXXXXXAICRNHIMDLCXXXXXXXXXXXIECQANQXSXTXXEXXXXXCXXAWGXXXXXNHAFHXHCIXRWLKXRXXXXXCPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXXXXXXXXXXXXXXXXXXXXXXXX

SEQ ID NO: 67837 - protein, 1174 aa, artificial
  consensus sequence
  misc_feature (1)..(382): Xaa can be any naturally occurring amino acid
  misc_feature (385)..(390): Xaa can be any naturally occurring amino acid
  misc_feature (392)..(416): Xaa can be any naturally occurring amino acid
  misc_feature (418)..(422): Xaa can be any naturally occurring amino acid
  misc_feature (424)..(514): Xaa can be any naturally occurring amino acid
  misc_feature (516)..(517): Xaa can be any naturally occurring amino acid
  misc_feature (519)..(536): Xaa can be any naturally occurring amino acid
  misc_feature (538)..(615): Xaa can be any naturally occurring amino acid
  misc_feature (619)..(620): Xaa can be any naturally occurring amino acid
  misc_feature (623)..(625): Xaa can be any naturally occurring amino acid
  misc_feature (628)..(628): Xaa can be any naturally occurring amino acid
  misc_feature (630)..(632): Xaa can be any naturally occurring amino acid
  misc_feature (634)..(635): Xaa can be any naturally occurring amino acid
  misc_feature (637)..(640): Xaa can be any naturally occurring amino acid
  misc_feature (642)..(661): Xaa can be any naturally occurring amino acid
  misc_feature (663)..(667): Xaa can be any naturally occurring amino acid
  misc_feature (671)..(672): Xaa can be any naturally occurring amino acid
  misc_feature (675)..(679): Xaa can be any naturally occurring amino acid
  misc_feature (681)..(681): Xaa can be any naturally occurring amino acid
  misc_feature (683)..(688): Xaa can be any naturally occurring amino acid
  misc_feature (690)..(690): Xaa can be any naturally occurring amino acid
  misc_feature (692)..(701): Xaa can be any naturally occurring amino acid
  misc_feature (703)..(1174): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSPXXXXXXSXXXXXXXXXXXXXXXXXXXXXXXXXQXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXEXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXVLKXXKNXXXHEXYXXXLXXRXXXXRXXXXXXXXXXXXXXXXXXXXQXXXXXKAAXXALXXXXXDXIXXXXXXQXNXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67838 - protein, 738 aa, artificial
  consensus sequence
  misc_feature (1)..(109): Xaa can be any naturally occurring amino acid
  misc_feature (111)..(157): Xaa can be any naturally occurring amino acid
  misc_feature (159)..(161): Xaa can be any naturally occurring amino acid
  misc_feature (163)..(165): Xaa can be any naturally occurring amino acid
  misc_feature (167)..(167): Xaa can be any naturally occurring amino acid
  misc_feature (170)..(170): Xaa can be any naturally occurring amino acid
  misc_feature (172)..(172): Xaa can be any naturally occurring amino acid
  misc_feature (174)..(174): Xaa can be any naturally occurring amino acid
  misc_feature (176)..(202): Xaa can be any naturally occurring amino acid
  misc_feature (204)..(206): Xaa can be any naturally occurring amino acid
  misc_feature (208)..(208): Xaa can be any naturally occurring amino acid
  misc_feature (214)..(214): Xaa can be any naturally occurring amino acid
  misc_feature (217)..(218): Xaa can be any naturally occurring amino acid
  misc_feature (220)..(220): Xaa can be any naturally occurring amino acid
  misc_feature (223)..(225): Xaa can be any naturally occurring amino acid
  misc_feature (227)..(229): Xaa can be any naturally occurring amino acid
  misc_feature (231)..(231): Xaa can be any naturally occurring amino acid
  misc_feature (233)..(233): Xaa can be any naturally occurring amino acid
  misc_feature (235)..(236): Xaa can be any naturally occurring amino acid
  misc_feature (238)..(239): Xaa can be any naturally occurring amino acid
  misc_feature (244)..(244): Xaa can be any naturally occurring amino acid
  misc_feature (246)..(247): Xaa can be any naturally occurring amino acid
  misc_feature (252)..(253): Xaa can be any naturally occurring amino acid
  misc_feature (256)..(256): Xaa can be any naturally occurring amino acid
  misc_feature (259)..(262): Xaa can be any naturally occurring amino acid
  misc_feature (264)..(266): Xaa can be any naturally occurring amino acid
  misc_feature (269)..(270): Xaa can be any naturally occurring amino acid
  misc_feature (274)..(275): Xaa can be any naturally occurring amino acid
  misc_feature (280)..(280): Xaa can be any naturally occurring amino acid
  misc_feature (284)..(285): Xaa can be any naturally occurring amino acid
  misc_feature (287)..(287): Xaa can be any naturally occurring amino acid
  misc_feature (291)..(291): Xaa can be any naturally occurring amino acid
  misc_feature (293)..(302): Xaa can be any naturally occurring amino acid
  misc_feature (307)..(307): Xaa can be any naturally occurring amino acid
  misc_feature (309)..(311): Xaa can be any naturally occurring amino acid
  misc_feature (314)..(314): Xaa can be any naturally occurring amino acid
  misc_feature (318)..(319): Xaa can be any naturally occurring amino acid
  misc_feature (321)..(321): Xaa can be any naturally occurring amino acid
  misc_feature (323)..(323): Xaa can be any naturally occurring amino acid
  misc_feature (326)..(326): Xaa can be any naturally occurring amino acid
  misc_feature (328)..(328): Xaa can be any naturally occurring amino acid
  misc_feature (330)..(330): Xaa can be any naturally occurring amino acid
  misc_feature (336)..(341): Xaa can be any naturally occurring amino acid
  misc_feature (343)..(344): Xaa can be any naturally occurring amino acid
  misc_feature (347)..(351): Xaa can be any naturally occurring amino acid
  misc_feature (353)..(353): Xaa can be any naturally occurring amino acid
  misc_feature (355)..(355): Xaa can be any naturally occurring amino acid
  misc_feature (358)..(358): Xaa can be any naturally occurring amino acid
  misc_feature (360)..(376): Xaa can be any naturally occurring amino acid
  misc_feature (379)..(380): Xaa can be any naturally occurring amino acid
  misc_feature (383)..(384): Xaa can be any naturally occurring amino acid
  misc_feature (392)..(392): Xaa can be any naturally occurring amino acid
  misc_feature (396)..(413): Xaa can be any naturally occurring amino acid
  misc_feature (417)..(417): Xaa can be any naturally occurring amino acid
  misc_feature (419)..(423): Xaa can be any naturally occurring amino acid
  misc_feature (425)..(428): Xaa can be any naturally occurring amino acid
  misc_feature (430)..(432): Xaa can be any naturally occurring amino acid
  misc_feature (434)..(435): Xaa can be any naturally occurring amino acid
  misc_feature (437)..(440): Xaa can be any naturally occurring amino acid
  misc_feature (442)..(443): Xaa can be any naturally occurring amino acid
  misc_feature (445)..(445): Xaa can be any naturally occurring amino acid
  misc_feature (447)..(450): Xaa can be any naturally occurring amino acid
  misc_feature (452)..(454): Xaa can be any naturally occurring amino acid
  misc_feature (460)..(460): Xaa can be any naturally occurring amino acid
  misc_feature (464)..(464): Xaa can be any naturally occurring amino acid
  misc_feature (466)..(466): Xaa can be any naturally occurring amino acid
  misc_feature (469)..(469): Xaa can be any naturally occurring amino acid
  misc_feature (472)..(473): Xaa can be any naturally occurring amino acid
  misc_feature (475)..(487): Xaa can be any naturally occurring amino acid
  misc_feature (490)..(491): Xaa can be any naturally occurring amino acid
  misc_feature (493)..(500): Xaa can be any naturally occurring amino acid
  misc_feature (502)..(507): Xaa can be any naturally occurring amino acid
  misc_feature (509)..(510): Xaa can be any naturally occurring amino acid
  misc_feature (512)..(738): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXFXXXFXXXRXTFXYXCXLXXXXXXXXXXXXXXXXXXXXXXXXXXXLXXXDXVAVALXRLXXGXSLXXXGXXXGXNXSXXSXXTWRFXEXXEERAXXHLXWPXXXXEXXXIKXXFEKXXGLPNXCCGXXDXTHIXMXXXXXXXXXXVWLDXEXXXSMXLQAXXDXDXRFXDXVXGWPGSXXXXXXLXXSGXXXXXEXGXRLXGXXXXXXXXXXXXXXXXXEYXXGDXXYPLLPWLXTPYXXXXXXXXXXXXXXXXXXFNKXHXXXXXVXXXXLXXXKXXWXXXXGXXWXPXXXXDXXXLPRIIXVCCXLXNIXIDXXDXXXXXXXXXXXXXHDXXYXXXXXXXXDXXXXXXRXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67839 - protein, 1392 aa, artificial
  consensus sequence
  misc_feature (1)..(455): Xaa can be any naturally occurring amino acid
  misc_feature (457)..(457): Xaa can be any naturally occurring amino acid
  misc_feature (459)..(460): Xaa can be any naturally occurring amino acid
  misc_feature (462)..(465): Xaa can be any naturally occurring amino acid
  misc_feature (467)..(544): Xaa can be any naturally occurring amino acid
  misc_feature (546)..(555): Xaa can be any naturally occurring amino acid
  misc_feature (558)..(558): Xaa can be any naturally occurring amino acid
  misc_feature (561)..(565): Xaa can be any naturally occurring amino acid
  misc_feature (568)..(573): Xaa can be any naturally occurring amino acid
  misc_feature (575)..(647): Xaa can be any naturally occurring amino acid
  misc_feature (649)..(649): Xaa can be any naturally occurring amino acid
  misc_feature (651)..(653): Xaa can be any naturally occurring amino acid
  misc_feature (655)..(659): Xaa can be any naturally occurring amino acid
  misc_feature (662)..(663): Xaa can be any naturally occurring amino acid
  misc_feature (665)..(666): Xaa can be any naturally occurring amino acid
  misc_feature (668)..(668): Xaa can be any naturally occurring amino acid
  misc_feature (670)..(673): Xaa can be any naturally occurring amino acid
  misc_feature (675)..(677): Xaa can be any naturally occurring amino acid
  misc_feature (680)..(690): Xaa can be any naturally occurring amino acid
  misc_feature (693)..(696): Xaa can be any naturally occurring amino acid
  misc_feature (698)..(699): Xaa can be any naturally occurring amino acid
  misc_feature (703)..(726): Xaa can be any naturally occurring amino acid
  misc_feature (728)..(739): Xaa can be any naturally occurring amino acid
  misc_feature (741)..(741): Xaa can be any naturally occurring amino acid
  misc_feature (745)..(745): Xaa can be any naturally occurring amino acid
  misc_feature (747)..(809): Xaa can be any naturally occurring amino acid
  misc_feature (811)..(816): Xaa can be any naturally occurring amino acid
  misc_feature (818)..(1392): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXVXXDXXXXFXXXXXXXXXXXXXXXXXXXXXXXXXXXXXXXXXXXXXXXXXXXXXXXXXXXXXXXXXXXXXXXXXXXXXXXXXXXXXXAXXXXXXXXXXREXAAXXXXXERXXXXXXGXXXXXXXXXXXXXXXXXXXXXXXXXXXXXXXXXXXXXXXXXXXXXXXXXXXXXXXXXXXXXXXXXXXXXXXXXLXYXXXGXXXXXENXXGXXAXFXXXXAXXXLAXXXXXXXXXXXFKXXXXVXXAHGXXXXXXXXXXXXXXXXXXXXXXXXFXXXXXXXXXXXXPXFLFXKXXXXXXXXXXXXXXXXXXXXXXXXXXXXXXXXXXXXXXXXXXXXXXXXXXXXXXXXXXXXXXXDXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67840 - protein, 126 aa, artificial
  consensus sequence
  misc_feature (1)..(13): Xaa can be any naturally occurring amino acid
  misc_feature (17)..(29): Xaa can be any naturally occurring amino acid
  misc_feature (33)..(33): Xaa can be any naturally occurring amino acid
  misc_feature (39)..(42): Xaa can be any naturally occurring amino acid
  misc_feature (55)..(55): Xaa can be any naturally occurring amino acid
  misc_feature (58)..(58): Xaa can be any naturally occurring amino acid
  misc_feature (60)..(66): Xaa can be any naturally occurring amino acid
  misc_feature (68)..(71): Xaa can be any naturally occurring amino acid
  misc_feature (73)..(77): Xaa can be any naturally occurring amino acid
  misc_feature (79)..(82): Xaa can be any naturally occurring amino acid
  misc_feature (86)..(92): Xaa can be any naturally occurring amino acid
  misc_feature (105)..(105): Xaa can be any naturally occurring amino acid
  misc_feature (112)..(121): Xaa can be any naturally occurring amino acid
  misc_feature (124)..(126): Xaa can be any naturally occurring amino acid
XXXXXXXXXXXXXMCPXXXXXXXXXXXXXLRFXLVFFSXXXXAVLAGYFAWKTVXSSXPXXXXXXXDXXXXEXXXXXKXXXXFKKXXXXXXXNGFWVFVDMASGXYLWRNLXXXXXXXXXXKSXXX

SEQ ID NO: 67841 - protein, 475 aa, artificial
  consensus sequence
  misc_feature (1)..(342): Xaa can be any naturally occurring amino acid
  misc_feature (346)..(346): Xaa can be any naturally occurring amino acid
  misc_feature (349)..(349): Xaa can be any naturally occurring amino acid
  misc_feature (351)..(351): Xaa can be any naturally occurring amino acid
  misc_feature (357)..(362): Xaa can be any naturally occurring amino acid
  misc_feature (365)..(367): Xaa can be any naturally occurring amino acid
  misc_feature (372)..(372): Xaa can be any naturally occurring amino acid
  misc_feature (374)..(374): Xaa can be any naturally occurring amino acid
  misc_feature (391)..(391): Xaa can be any naturally occurring amino acid
  misc_feature (395)..(395): Xaa can be any naturally occurring amino acid
  misc_feature (399)..(399): Xaa can be any naturally occurring amino acid
  misc_feature (401)..(401): Xaa can be any naturally occurring amino acid
  misc_feature (405)..(408): Xaa can be any naturally occurring amino acid
  misc_feature (410)..(410): Xaa can be any naturally occurring amino acid
  misc_feature (412)..(412): Xaa can be any naturally occurring amino acid
  misc_feature (415)..(427): Xaa can be any naturally occurring amino acid
  misc_feature (429)..(429): Xaa can be any naturally occurring amino acid
  misc_feature (432)..(437): Xaa can be any naturally occurring amino acid
  misc_feature (439)..(442): Xaa can be any naturally occurring amino acid
  misc_feature (444)..(445): Xaa can be any naturally occurring amino acid
  misc_feature (448)..(449): Xaa can be any naturally occurring amino acid
  misc_feature (451)..(451): Xaa can be any naturally occurring amino acid
  misc_feature (456)..(456): Xaa can be any naturally occurring amino acid
  misc_feature (459)..(459): Xaa can be any naturally occurring amino acid
  misc_feature (464)..(465): Xaa can be any naturally occurring amino acid
  misc_feature (468)..(468): Xaa can be any naturally occurring amino acid
  misc_feature (470)..(475): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXATGXKRXNXNTRPVXXXXXXKQXXXKGPYXKXPGCTTSCGLRLPRKTEXTAAXLIKXLXCKFXXXXRXVXMRXXXXXXXXXXXXXSXSGXXXXXXIXXXXDXXHRXXAXEDCIXFIXSSSSXXRSXSXXXXXX

SEQ ID NO: 67842 - protein, 202 aa, artificial
  consensus sequence
  misc_feature (1)..(3): Xaa can be any naturally occurring amino acid
  misc_feature (5)..(7): Xaa can be any naturally occurring amino acid
  misc_feature (9)..(11): Xaa can be any naturally occurring amino acid
  misc_feature (13)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (31)..(34): Xaa can be any naturally occurring amino acid
  misc_feature (36)..(36): Xaa can be any naturally occurring amino acid
  misc_feature (39)..(39): Xaa can be any naturally occurring amino acid
  misc_feature (42)..(42): Xaa can be any naturally occurring amino acid
  misc_feature (44)..(44): Xaa can be any naturally occurring amino acid
  misc_feature (47)..(49): Xaa can be any naturally occurring amino acid
  misc_feature (51)..(51): Xaa can be any naturally occurring amino acid
  misc_feature (53)..(54): Xaa can be any naturally occurring amino acid
  misc_feature (56)..(57): Xaa can be any naturally occurring amino acid
  misc_feature (59)..(59): Xaa can be any naturally occurring amino acid
  misc_feature (62)..(63): Xaa can be any naturally occurring amino acid
  misc_feature (65)..(66): Xaa can be any naturally occurring amino acid
  misc_feature (68)..(68): Xaa can be any naturally occurring amino acid
  misc_feature (71)..(71): Xaa can be any naturally occurring amino acid
  misc_feature (74)..(74): Xaa can be any naturally occurring amino acid
  misc_feature (79)..(91): Xaa can be any naturally occurring amino acid
  misc_feature (93)..(102): Xaa can be any naturally occurring amino acid
  misc_feature (104)..(104): Xaa can be any naturally occurring amino acid
  misc_feature (113)..(115): Xaa can be any naturally occurring amino acid
  misc_feature (122)..(125): Xaa can be any naturally occurring amino acid
  misc_feature (127)..(149): Xaa can be any naturally occurring amino acid
  misc_feature (152)..(202): Xaa can be any naturally occurring amino acid
XXXYXXXRXXXSXXXXFXLSPLPYPVXLILXXXXLXLGXSWXFXYEXXXEXAXXQXXWXLLXXPXXLXLLXRWXSSVDXXXXXXXXXXXXXRXXXXXXXXXXEXGSSPWGVAXXXLLLLVLXXXXSXXXXXXXXXXXXXXXXXXXXXXXMWXXXXXXXXXXXXXXXXXXXXXXXXXXXXXXXXXXXXXXXXXXXXXXXXXXX

SEQ ID NO: 67843 - protein, 651 aa, artificial
  consensus sequence
  misc_feature (1)..(72): Xaa can be any naturally occurring amino acid
  misc_feature (74)..(86): Xaa can be any naturally occurring amino acid
  misc_feature (88)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (99)..(99): Xaa can be any naturally occurring amino acid
  misc_feature (103)..(103): Xaa can be any naturally occurring amino acid
  misc_feature (108)..(111): Xaa can be any naturally occurring amino acid
  misc_feature (114)..(115): Xaa can be any naturally occurring amino acid
  misc_feature (119)..(129): Xaa can be any naturally occurring amino acid
  misc_feature (131)..(131): Xaa can be any naturally occurring amino acid
  misc_feature (134)..(134): Xaa can be any naturally occurring amino acid
  misc_feature (139)..(143): Xaa can be any naturally occurring amino acid
  misc_feature (145)..(147): Xaa can be any naturally occurring amino acid
  misc_feature (149)..(156): Xaa can be any naturally occurring amino acid
  misc_feature (158)..(159): Xaa can be any naturally occurring amino acid
  misc_feature (162)..(173): Xaa can be any naturally occurring amino acid
  misc_feature (177)..(178): Xaa can be any naturally occurring amino acid
  misc_feature (181)..(186): Xaa can be any naturally occurring amino acid
  misc_feature (188)..(188): Xaa can be any naturally occurring amino acid
  misc_feature (190)..(192): Xaa can be any naturally occurring amino acid
  misc_feature (195)..(197): Xaa can be any naturally occurring amino acid
  misc_feature (200)..(200): Xaa can be any naturally occurring amino acid
  misc_feature (203)..(206): Xaa can be any naturally occurring amino acid
  misc_feature (208)..(208): Xaa can be any naturally occurring amino acid
  misc_feature (210)..(213): Xaa can be any naturally occurring amino acid
  misc_feature (215)..(216): Xaa can be any naturally occurring amino acid
  misc_feature (219)..(220): Xaa can be any naturally occurring amino acid
  misc_feature (223)..(223): Xaa can be any naturally occurring amino acid
  misc_feature (226)..(228): Xaa can be any naturally occurring amino acid
  misc_feature (231)..(232): Xaa can be any naturally occurring amino acid
  misc_feature (234)..(234): Xaa can be any naturally occurring amino acid
  misc_feature (238)..(239): Xaa can be any naturally occurring amino acid
  misc_feature (242)..(244): Xaa can be any naturally occurring amino acid
  misc_feature (247)..(255): Xaa can be any naturally occurring amino acid
  misc_feature (258)..(259): Xaa can be any naturally occurring amino acid
  misc_feature (263)..(263): Xaa can be any naturally occurring amino acid
  misc_feature (265)..(265): Xaa can be any naturally occurring amino acid
  misc_feature (268)..(272): Xaa can be any naturally occurring amino acid
  misc_feature (275)..(277): Xaa can be any naturally occurring amino acid
  misc_feature (283)..(292): Xaa can be any naturally occurring amino acid
  misc_feature (294)..(302): Xaa can be any naturally occurring amino acid
  misc_feature (304)..(316): Xaa can be any naturally occurring amino acid
  misc_feature (318)..(327): Xaa can be any naturally occurring amino acid
  misc_feature (329)..(330): Xaa can be any naturally occurring amino acid
  misc_feature (333)..(333): Xaa can be any naturally occurring amino acid
  misc_feature (335)..(335): Xaa can be any naturally occurring amino acid
  misc_feature (337)..(354): Xaa can be any naturally occurring amino acid
  misc_feature (356)..(358): Xaa can be any naturally occurring amino acid
  misc_feature (360)..(360): Xaa can be any naturally occurring amino acid
  misc_feature (367)..(367): Xaa can be any naturally occurring amino acid
  misc_feature (379)..(381): Xaa can be any naturally occurring amino acid
  misc_feature (383)..(385): Xaa can be any naturally occurring amino acid
  misc_feature (387)..(387): Xaa can be any naturally occurring amino acid
  misc_feature (389)..(389): Xaa can be any naturally occurring amino acid
  misc_feature (391)..(394): Xaa can be any naturally occurring amino acid
  misc_feature (396)..(397): Xaa can be any naturally occurring amino acid
  misc_feature (400)..(401): Xaa can be any naturally occurring amino acid
  misc_feature (404)..(406): Xaa can be any naturally occurring amino acid
  misc_feature (408)..(409): Xaa can be any naturally occurring amino acid
  misc_feature (411)..(412): Xaa can be any naturally occurring amino acid
  misc_feature (416)..(417): Xaa can be any naturally occurring amino acid
  misc_feature (419)..(420): Xaa can be any naturally occurring amino acid
  misc_feature (422)..(424): Xaa can be any naturally occurring amino acid
  misc_feature (426)..(427): Xaa can be any naturally occurring amino acid
  misc_feature (429)..(435): Xaa can be any naturally occurring amino acid
  misc_feature (437)..(457): Xaa can be any naturally occurring amino acid
  misc_feature (459)..(460): Xaa can be any naturally occurring amino acid
  misc_feature (462)..(471): Xaa can be any naturally occurring amino acid
  misc_feature (474)..(474): Xaa can be any naturally occurring amino acid
  misc_feature (477)..(482): Xaa can be any naturally occurring amino acid
  misc_feature (484)..(485): Xaa can be any naturally occurring amino acid
  misc_feature (487)..(488): Xaa can be any naturally occurring amino acid
  misc_feature (490)..(496): Xaa can be any naturally occurring amino acid
  misc_feature (498)..(499): Xaa can be any naturally occurring amino acid
  misc_feature (501)..(501): Xaa can be any naturally occurring amino acid
  misc_feature (503)..(503): Xaa can be any naturally occurring amino acid
  misc_feature (506)..(506): Xaa can be any naturally occurring amino acid
  misc_feature (508)..(508): Xaa can be any naturally occurring amino acid
  misc_feature (512)..(517): Xaa can be any naturally occurring amino acid
  misc_feature (525)..(525): Xaa can be any naturally occurring amino acid
  misc_feature (528)..(528): Xaa can be any naturally occurring amino acid
  misc_feature (530)..(530): Xaa can be any naturally occurring amino acid
  misc_feature (533)..(533): Xaa can be any naturally occurring amino acid
  misc_feature (536)..(536): Xaa can be any naturally occurring amino acid
  misc_feature (540)..(545): Xaa can be any naturally occurring amino acid
  misc_feature (547)..(547): Xaa can be any naturally occurring amino acid
  misc_feature (549)..(549): Xaa can be any naturally occurring amino acid
  misc_feature (551)..(551): Xaa can be any naturally occurring amino acid
  misc_feature (553)..(553): Xaa can be any naturally occurring amino acid
  misc_feature (556)..(556): Xaa can be any naturally occurring amino acid
  misc_feature (561)..(568): Xaa can be any naturally occurring amino acid
  misc_feature (570)..(570): Xaa can be any naturally occurring amino acid
  misc_feature (573)..(573): Xaa can be any naturally occurring amino acid
  misc_feature (575)..(651): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXPXXXXXXXXXXXXXCXXXAXGGFXFGXDTGXISGFXXXXDFXXRFGXXXXXXXXXXXSXVRXGLIVXXXXXGXXXGXXXXXXXXDXXGRXXXXXXXXXXXXVGIXXQIXXXXXXWXQXXXGRXXXGLXVGXXXXLXPXXXXEXXPKXXRGXLVXXXQLXXTXGIFXXYCXXXGTXXXXXXXXXWRXXLGLXFXWAXXXXXGMXXXPESPRXXXXXXXXXXAXXXXXXXXXVXXXXXXXXXXXXXEXXXXXXXXXXEXXAGXAXWXXXXXXXXXXXXXXXXXXGXXXQXLQQLTGXNYFFYYGTTIFXXXGXXXSXFXTXXXXGXXNFXXTFXXXYXXEXXGRRXXLXXGXXXMXXCXXXXXXXGXXXXXXXXXXXXXXXXXXXXXGXXMXXXXXXXXXXFAXTWXXXXXXIXXEXXPXXXXXXXMXXAXAXNWXWXFLIXXXXXXFFTPFITXAIXFXYGXVFXGCLXXXXXXVXFXVXEXKGXTLEEXXXXXXXXVXPWXSXXXXXXXXXXXXXXXXXXXXXXXXXXXXXXXXXXXXXXXXXXXXXXXXXXXXXXXXXXXXXXXXXXXXXXXXXXXXX

SEQ ID NO: 67844 - protein, 375 aa, artificial
  consensus sequence
  misc_feature (1)..(226): Xaa can be any naturally occurring amino acid
  misc_feature (228)..(241): Xaa can be any naturally occurring amino acid
  misc_feature (249)..(249): Xaa can be any naturally occurring amino acid
  misc_feature (253)..(255): Xaa can be any naturally occurring amino acid
  misc_feature (257)..(257): Xaa can be any naturally occurring amino acid
  misc_feature (260)..(260): Xaa can be any naturally occurring amino acid
  misc_feature (262)..(262): Xaa can be any naturally occurring amino acid
  misc_feature (268)..(268): Xaa can be any naturally occurring amino acid
  misc_feature (276)..(285): Xaa can be any naturally occurring amino acid
  misc_feature (289)..(289): Xaa can be any naturally occurring amino acid
  misc_feature (292)..(293): Xaa can be any naturally occurring amino acid
  misc_feature (296)..(298): Xaa can be any naturally occurring amino acid
  misc_feature (301)..(301): Xaa can be any naturally occurring amino acid
  misc_feature (306)..(309): Xaa can be any naturally occurring amino acid
  misc_feature (311)..(311): Xaa can be any naturally occurring amino acid
  misc_feature (313)..(313): Xaa can be any naturally occurring amino acid
  misc_feature (315)..(317): Xaa can be any naturally occurring amino acid
  misc_feature (325)..(327): Xaa can be any naturally occurring amino acid
  misc_feature (329)..(336): Xaa can be any naturally occurring amino acid
  misc_feature (341)..(341): Xaa can be any naturally occurring amino acid
  misc_feature (345)..(346): Xaa can be any naturally occurring amino acid
  misc_feature (349)..(350): Xaa can be any naturally occurring amino acid
  misc_feature (355)..(355): Xaa can be any naturally occurring amino acid
  misc_feature (363)..(363): Xaa can be any naturally occurring amino acid
  misc_feature (366)..(366): Xaa can be any naturally occurring amino acid
  misc_feature (368)..(371): Xaa can be any naturally occurring amino acid
  misc_feature (373)..(373): Xaa can be any naturally occurring amino acid
  misc_feature (375)..(375): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXDGVSLGTXKLPXXXDXARXEXLLFQWXNSLCQGAXXXXXXXXXXPLPXVPXXVDXXXGGXRLGFXXXXDXGXTXXXVYIDCLVXXXTXXXXXXXXVFRAXRNGXXKDXXPPGEXRIMRSLLXALXKXXXXAXVX

SEQ ID NO: 67845 - protein, 1010 aa, artificial
  consensus sequence
  misc_feature (1)..(124): Xaa can be any naturally occurring amino acid
  misc_feature (126)..(132): Xaa can be any naturally occurring amino acid
  misc_feature (134)..(134): Xaa can be any naturally occurring amino acid
  misc_feature (136)..(141): Xaa can be any naturally occurring amino acid
  misc_feature (143)..(145): Xaa can be any naturally occurring amino acid
  misc_feature (151)..(194): Xaa can be any naturally occurring amino acid
  misc_feature (196)..(199): Xaa can be any naturally occurring amino acid
  misc_feature (201)..(202): Xaa can be any naturally occurring amino acid
  misc_feature (204)..(205): Xaa can be any naturally occurring amino acid
  misc_feature (209)..(211): Xaa can be any naturally occurring amino acid
  misc_feature (213)..(215): Xaa can be any naturally occurring amino acid
  misc_feature (217)..(220): Xaa can be any naturally occurring amino acid
  misc_feature (222)..(222): Xaa can be any naturally occurring amino acid
  misc_feature (225)..(225): Xaa can be any naturally occurring amino acid
  misc_feature (228)..(229): Xaa can be any naturally occurring amino acid
  misc_feature (231)..(231): Xaa can be any naturally occurring amino acid
  misc_feature (234)..(236): Xaa can be any naturally occurring amino acid
  misc_feature (238)..(239): Xaa can be any naturally occurring amino acid
  misc_feature (241)..(242): Xaa can be any naturally occurring amino acid
  misc_feature (244)..(244): Xaa can be any naturally occurring amino acid
  misc_feature (246)..(248): Xaa can be any naturally occurring amino acid
  misc_feature (250)..(254): Xaa can be any naturally occurring amino acid
  misc_feature (256)..(257): Xaa can be any naturally occurring amino acid
  misc_feature (260)..(261): Xaa can be any naturally occurring amino acid
  misc_feature (264)..(1010): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXIXDXXXXXXNXXXCHQCRXXXXXXXXXXXXXXXXXXXXXXXXXXXXXXXXXXXXXXXXXXXXCXXXXCXXCXXNRYXXXAXXXAXXXXWXCPXCRXXCXCSXXXKXXGXXPXGXXXHXXXXXGXXSVXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67846 - protein, 126 aa, artificial
  consensus sequence
  misc_feature (4)..(4): Xaa can be any naturally occurring amino acid
  misc_feature (12)..(12): Xaa can be any naturally occurring amino acid
  misc_feature (15)..(15): Xaa can be any naturally occurring amino acid
  misc_feature (20)..(21): Xaa can be any naturally occurring amino acid
  misc_feature (24)..(26): Xaa can be any naturally occurring amino acid
  misc_feature (30)..(30): Xaa can be any naturally occurring amino acid
  misc_feature (32)..(32): Xaa can be any naturally occurring amino acid
  misc_feature (35)..(35): Xaa can be any naturally occurring amino acid
  misc_feature (39)..(40): Xaa can be any naturally occurring amino acid
  misc_feature (43)..(44): Xaa can be any naturally occurring amino acid
  misc_feature (46)..(46): Xaa can be any naturally occurring amino acid
  misc_feature (49)..(49): Xaa can be any naturally occurring amino acid
  misc_feature (58)..(58): Xaa can be any naturally occurring amino acid
  misc_feature (60)..(60): Xaa can be any naturally occurring amino acid
  misc_feature (62)..(62): Xaa can be any naturally occurring amino acid
  misc_feature (65)..(65): Xaa can be any naturally occurring amino acid
  misc_feature (68)..(68): Xaa can be any naturally occurring amino acid
  misc_feature (73)..(74): Xaa can be any naturally occurring amino acid
  misc_feature (84)..(86): Xaa can be any naturally occurring amino acid
  misc_feature (88)..(126): Xaa can be any naturally occurring amino acid
MGFXMEFAENLXLRXMEDPXXRDXXXREHXYXMKXERCXXTKXXWXLPXRPYGFWTFXRXNXQLXWDXQISQXXGRRDPYDDLXXXHXXXXXXXXXXXXXXXXXXXXXXXXXXXXXXXXXXXXXXX

SEQ ID NO: 67847 - protein, 1071 aa, artificial
  consensus sequence
  misc_feature (1)..(93): Xaa can be any naturally occurring amino acid
  misc_feature (95)..(127): Xaa can be any naturally occurring amino acid
  misc_feature (131)..(131): Xaa can be any naturally occurring amino acid
  misc_feature (133)..(133): Xaa can be any naturally occurring amino acid
  misc_feature (135)..(135): Xaa can be any naturally occurring amino acid
  misc_feature (139)..(143): Xaa can be any naturally occurring amino acid
  misc_feature (145)..(157): Xaa can be any naturally occurring amino acid
  misc_feature (159)..(163): Xaa can be any naturally occurring amino acid
  misc_feature (167)..(169): Xaa can be any naturally occurring amino acid
  misc_feature (172)..(232): Xaa can be any naturally occurring amino acid
  misc_feature (234)..(326): Xaa can be any naturally occurring amino acid
  misc_feature (329)..(335): Xaa can be any naturally occurring amino acid
  misc_feature (340)..(340): Xaa can be any naturally occurring amino acid
  misc_feature (343)..(1071): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXVAPXFXGXLKSXXXXXPXXXXXXXXXXXXXSXXXXXGGRXXXCMXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKXXXXXXXTLSYXLPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67848 - protein, 907 aa, artificial
  consensus sequence
  misc_feature (1)..(90): Xaa can be any naturally occurring amino acid
  misc_feature (92)..(164): Xaa can be any naturally occurring amino acid
  misc_feature (168)..(168): Xaa can be any naturally occurring amino acid
  misc_feature (170)..(170): Xaa can be any naturally occurring amino acid
  misc_feature (172)..(172): Xaa can be any naturally occurring amino acid
  misc_feature (176)..(180): Xaa can be any naturally occurring amino acid
  misc_feature (182)..(194): Xaa can be any naturally occurring amino acid
  misc_feature (196)..(198): Xaa can be any naturally occurring amino acid
  misc_feature (200)..(200): Xaa can be any naturally occurring amino acid
  misc_feature (203)..(205): Xaa can be any naturally occurring amino acid
  misc_feature (208)..(215): Xaa can be any naturally occurring amino acid
  misc_feature (218)..(222): Xaa can be any naturally occurring amino acid
  misc_feature (227)..(227): Xaa can be any naturally occurring amino acid
  misc_feature (232)..(232): Xaa can be any naturally occurring amino acid
  misc_feature (235)..(235): Xaa can be any naturally occurring amino acid
  misc_feature (237)..(315): Xaa can be any naturally occurring amino acid
  misc_feature (317)..(383): Xaa can be any naturally occurring amino acid
  misc_feature (386)..(907): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXXXXXXXXXXXXXXXXXXXXXXXXXXXXXXXXXXXXXXXXXVAPXFXGXLKSXXXXXPXXXXXXXXXXXXXSXXXNXGRXXXCMXXXXXXXXWPXXXXXKKFEXTLSYXLPXLXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXPCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67849 - protein, 1292 aa, artificial
  consensus sequence
  misc_feature (1)..(102): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(110): Xaa can be any naturally occurring amino acid
  misc_feature (114)..(119): Xaa can be any naturally occurring amino acid
  misc_feature (121)..(134): Xaa can be any naturally occurring amino acid
  misc_feature (136)..(141): Xaa can be any naturally occurring amino acid
  misc_feature (144)..(145): Xaa can be any naturally occurring amino acid
  misc_feature (148)..(208): Xaa can be any naturally occurring amino acid
  misc_feature (210)..(211): Xaa can be any naturally occurring amino acid
  misc_feature (213)..(312): Xaa can be any naturally occurring amino acid
  misc_feature (317)..(317): Xaa can be any naturally occurring amino acid
  misc_feature (321)..(321): Xaa can be any naturally occurring amino acid
  misc_feature (325)..(1292): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVAPXFXGXLKSXXXXXXPXXXXXXXXXXXXXXSXXXXXXGRXXCMXXXXXXXXXXXXXXXXXXXXXXXXXXXXXXXXXXXXXXXXXXXXXXXXXXXXXXXXXXXXXPXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKFEXTLSXYLPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67850 - protein, 1208 aa, artificial
  consensus sequence
  misc_feature (1)..(103): Xaa can be any naturally occurring amino acid
  misc_feature (108)..(108): Xaa can be any naturally occurring amino acid
  misc_feature (110)..(110): Xaa can be any naturally occurring amino acid
  misc_feature (114)..(119): Xaa can be any naturally occurring amino acid
  misc_feature (121)..(134): Xaa can be any naturally occurring amino acid
  misc_feature (136)..(137): Xaa can be any naturally occurring amino acid
  misc_feature (140)..(141): Xaa can be any naturally occurring amino acid
  misc_feature (145)..(146): Xaa can be any naturally occurring amino acid
  misc_feature (149)..(151): Xaa can be any naturally occurring amino acid
  misc_feature (154)..(156): Xaa can be any naturally occurring amino acid
  misc_feature (158)..(158): Xaa can be any naturally occurring amino acid
  misc_feature (161)..(161): Xaa can be any naturally occurring amino acid
  misc_feature (163)..(163): Xaa can be any naturally occurring amino acid
  misc_feature (167)..(176): Xaa can be any naturally occurring amino acid
  misc_feature (180)..(181): Xaa can be any naturally occurring amino acid
  misc_feature (183)..(196): Xaa can be any naturally occurring amino acid
  misc_feature (198)..(308): Xaa can be any naturally occurring amino acid
  misc_feature (310)..(311): Xaa can be any naturally occurring amino acid
  misc_feature (315)..(326): Xaa can be any naturally occurring amino acid
  misc_feature (328)..(349): Xaa can be any naturally occurring amino acid
  misc_feature (351)..(352): Xaa can be any naturally occurring amino acid
  misc_feature (357)..(1208): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVAPFXGXLKSXXXXXXPXXXXXXXXXXXXXXSXXSNXXGGRXXCMXXXWPXXXGXKKXEXTLSXXXXXXXXXXYLPXXLXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXPCLXXXXXXXXXXXXRXXXXXXXXXXXXXXXXXXXXXXYXXGRYWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67851 - protein, 905 aa, artificial
  consensus sequence
  misc_feature (1)..(191): Xaa can be any naturally occurring amino acid
  misc_feature (194)..(198): Xaa can be any naturally occurring amino acid
  misc_feature (200)..(201): Xaa can be any naturally occurring amino acid
  misc_feature (203)..(205): Xaa can be any naturally occurring amino acid
  misc_feature (207)..(208): Xaa can be any naturally occurring amino acid
  misc_feature (211)..(215): Xaa can be any naturally occurring amino acid
  misc_feature (217)..(218): Xaa can be any naturally occurring amino acid
  misc_feature (227)..(260): Xaa can be any naturally occurring amino acid
  misc_feature (263)..(264): Xaa can be any naturally occurring amino acid
  misc_feature (266)..(267): Xaa can be any naturally occurring amino acid
  misc_feature (269)..(273): Xaa can be any naturally occurring amino acid
  misc_feature (275)..(279): Xaa can be any naturally occurring amino acid
  misc_feature (282)..(297): Xaa can be any naturally occurring amino acid
  misc_feature (301)..(301): Xaa can be any naturally occurring amino acid
  misc_feature (306)..(306): Xaa can be any naturally occurring amino acid
  misc_feature (310)..(329): Xaa can be any naturally occurring amino acid
  misc_feature (331)..(331): Xaa can be any naturally occurring amino acid
  misc_feature (333)..(341): Xaa can be any naturally occurring amino acid
  misc_feature (343)..(344): Xaa can be any naturally occurring amino acid
  misc_feature (346)..(347): Xaa can be any naturally occurring amino acid
  misc_feature (349)..(349): Xaa can be any naturally occurring amino acid
  misc_feature (353)..(353): Xaa can be any naturally occurring amino acid
  misc_feature (361)..(361): Xaa can be any naturally occurring amino acid
  misc_feature (363)..(363): Xaa can be any naturally occurring amino acid
  misc_feature (365)..(365): Xaa can be any naturally occurring amino acid
  misc_feature (367)..(369): Xaa can be any naturally occurring amino acid
  misc_feature (371)..(371): Xaa can be any naturally occurring amino acid
  misc_feature (375)..(375): Xaa can be any naturally occurring amino acid
  misc_feature (378)..(378): Xaa can be any naturally occurring amino acid
  misc_feature (380)..(386): Xaa can be any naturally occurring amino acid
  misc_feature (388)..(388): Xaa can be any naturally occurring amino acid
  misc_feature (391)..(395): Xaa can be any naturally occurring amino acid
  misc_feature (397)..(409): Xaa can be any naturally occurring amino acid
  misc_feature (412)..(414): Xaa can be any naturally occurring amino acid
  misc_feature (417)..(417): Xaa can be any naturally occurring amino acid
  misc_feature (421)..(423): Xaa can be any naturally occurring amino acid
  misc_feature (425)..(425): Xaa can be any naturally occurring amino acid
  misc_feature (427)..(434): Xaa can be any naturally occurring amino acid
  misc_feature (436)..(449): Xaa can be any naturally occurring amino acid
  misc_feature (451)..(452): Xaa can be any naturally occurring amino acid
  misc_feature (454)..(465): Xaa can be any naturally occurring amino acid
  misc_feature (469)..(469): Xaa can be any naturally occurring amino acid
  misc_feature (475)..(476): Xaa can be any naturally occurring amino acid
  misc_feature (478)..(478): Xaa can be any naturally occurring amino acid
  misc_feature (482)..(482): Xaa can be any naturally occurring amino acid
  misc_feature (484)..(485): Xaa can be any naturally occurring amino acid
  misc_feature (488)..(488): Xaa can be any naturally occurring amino acid
  misc_feature (490)..(491): Xaa can be any naturally occurring amino acid
  misc_feature (493)..(493): Xaa can be any naturally occurring amino acid
  misc_feature (495)..(495): Xaa can be any naturally occurring amino acid
  misc_feature (499)..(499): Xaa can be any naturally occurring amino acid
  misc_feature (503)..(503): Xaa can be any naturally occurring amino acid
  misc_feature (505)..(507): Xaa can be any naturally occurring amino acid
  misc_feature (509)..(514): Xaa can be any naturally occurring amino acid
  misc_feature (516)..(905): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSCXXXXXTXXWXXXIXXFLXXXXXLXXAHVVNFFKXXXXXXXXXXXXXXXXXXXXXXXXXXXXXXXXXXWPXXLXXFXXXXXSXXXXXEQXXXXXXXXXXXXXXXXTVLXQGMNXKKKXXXXXXXXXXXXXXXXXXXXEXLXXXXXXXXXSXXAXXVXDVGXGQGYLAQXLXFXYXXXVXAIDXSSXHXXXXXXXAXRIXXXXXAXXXXXXXXXXXXXVPXXXTCXVLSXXXLXAXXXXXXXXDXXXXXXXXXXXXXXSXXQXXXXXXXXXXXXLAGXHACGDXXVXMLRXFXXCEXVXXLXSXGCCXNLLXEXXXEXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67852 - protein, 232 aa, artificial
  consensus sequence
  misc_feature (1)..(3): Xaa can be any naturally occurring amino acid
  misc_feature (9)..(10): Xaa can be any naturally occurring amino acid
  misc_feature (12)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (22)..(23): Xaa can be any naturally occurring amino acid
  misc_feature (25)..(26): Xaa can be any naturally occurring amino acid
  misc_feature (29)..(29): Xaa can be any naturally occurring amino acid
  misc_feature (40)..(41): Xaa can be any naturally occurring amino acid
  misc_feature (43)..(45): Xaa can be any naturally occurring amino acid
  misc_feature (47)..(48): Xaa can be any naturally occurring amino acid
  misc_feature (51)..(51): Xaa can be any naturally occurring amino acid
  misc_feature (57)..(58): Xaa can be any naturally occurring amino acid
  misc_feature (63)..(63): Xaa can be any naturally occurring amino acid
  misc_feature (66)..(66): Xaa can be any naturally occurring amino acid
  misc_feature (69)..(69): Xaa can be any naturally occurring amino acid
  misc_feature (71)..(71): Xaa can be any naturally occurring amino acid
  misc_feature (73)..(73): Xaa can be any naturally occurring amino acid
  misc_feature (75)..(78): Xaa can be any naturally occurring amino acid
  misc_feature (81)..(83): Xaa can be any naturally occurring amino acid
  misc_feature (86)..(86): Xaa can be any naturally occurring amino acid
  misc_feature (88)..(89): Xaa can be any naturally occurring amino acid
  misc_feature (91)..(97): Xaa can be any naturally occurring amino acid
  misc_feature (101)..(127): Xaa can be any naturally occurring amino acid
  misc_feature (129)..(148): Xaa can be any naturally occurring amino acid
  misc_feature (151)..(151): Xaa can be any naturally occurring amino acid
  misc_feature (157)..(157): Xaa can be any naturally occurring amino acid
  misc_feature (160)..(160): Xaa can be any naturally occurring amino acid
  misc_feature (163)..(167): Xaa can be any naturally occurring amino acid
  misc_feature (169)..(169): Xaa can be any naturally occurring amino acid
  misc_feature (171)..(201): Xaa can be any naturally occurring amino acid
  misc_feature (203)..(203): Xaa can be any naturally occurring amino acid
  misc_feature (206)..(207): Xaa can be any naturally occurring amino acid
  misc_feature (211)..(232): Xaa can be any naturally occurring amino acid
XXXGKKRKXXAXXXXLXEXDRXXYXXFRXAANSLSQLYTXXMXXXQXXSFXAGERHXXEKLYXWIXRQXEXGXRXXXXDIXXXIQXEXXYXXXXXXXSPRXXXXXXXXXXXXXXXXXXXXXXXXXXXPXXXXXXXXXXXXXXXXXXXXFSXALSSPXRRXLQXXXXXQXGXXXXXXXXXXXXXXXXXXXXXXXXXXXXXXXSXDSXXDMHXXXXXXXXXXXXXXXXXXXXXX

SEQ ID NO: 67853 - protein, 2074 aa, artificial
  consensus sequence
  misc_feature (1)..(491): Xaa can be any naturally occurring amino acid
  misc_feature (493)..(494): Xaa can be any naturally occurring amino acid
  misc_feature (496)..(496): Xaa can be any naturally occurring amino acid
  misc_feature (498)..(500): Xaa can be any naturally occurring amino acid
  misc_feature (502)..(503): Xaa can be any naturally occurring amino acid
  misc_feature (506)..(509): Xaa can be any naturally occurring amino acid
  misc_feature (513)..(513): Xaa can be any naturally occurring amino acid
  misc_feature (515)..(517): Xaa can be any naturally occurring amino acid
  misc_feature (520)..(520): Xaa can be any naturally occurring amino acid
  misc_feature (522)..(522): Xaa can be any naturally occurring amino acid
  misc_feature (526)..(526): Xaa can be any naturally occurring amino acid
  misc_feature (530)..(541): Xaa can be any naturally occurring amino acid
  misc_feature (544)..(546): Xaa can be any naturally occurring amino acid
  misc_feature (549)..(549): Xaa can be any naturally occurring amino acid
  misc_feature (552)..(558): Xaa can be any naturally occurring amino acid
  misc_feature (560)..(563): Xaa can be any naturally occurring amino acid
  misc_feature (566)..(567): Xaa can be any naturally occurring amino acid
  misc_feature (570)..(570): Xaa can be any naturally occurring amino acid
  misc_feature (572)..(582): Xaa can be any naturally occurring amino acid
  misc_feature (584)..(588): Xaa can be any naturally occurring amino acid
  misc_feature (590)..(598): Xaa can be any naturally occurring amino acid
  misc_feature (600)..(619): Xaa can be any naturally occurring amino acid
  misc_feature (621)..(621): Xaa can be any naturally occurring amino acid
  misc_feature (623)..(634): Xaa can be any naturally occurring amino acid
  misc_feature (636)..(658): Xaa can be any naturally occurring amino acid
  misc_feature (662)..(669): Xaa can be any naturally occurring amino acid
  misc_feature (671)..(673): Xaa can be any naturally occurring amino acid
  misc_feature (677)..(677): Xaa can be any naturally occurring amino acid
  misc_feature (679)..(681): Xaa can be any naturally occurring amino acid
  misc_feature (683)..(693): Xaa can be any naturally occurring amino acid
  misc_feature (695)..(744): Xaa can be any naturally occurring amino acid
  misc_feature (746)..(821): Xaa can be any naturally occurring amino acid
  misc_feature (823)..(824): Xaa can be any naturally occurring amino acid
  misc_feature (826)..(829): Xaa can be any naturally occurring amino acid
  misc_feature (831)..(831): Xaa can be any naturally occurring amino acid
  misc_feature (833)..(837): Xaa can be any naturally occurring amino acid
  misc_feature (839)..(840): Xaa can be any naturally occurring amino acid
  misc_feature (843)..(918): Xaa can be any naturally occurring amino acid
  misc_feature (920)..(2074): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXDXEXXXVXXAEXXXXFVDXLXXXLTXPXGTIXRLLXXXXXXXXXXXXGCXXXLYXSVXXXXXXXFXXXXCKXXLLXPXXXXXXXXXXXKXXXXXDXXXXXXXXXCXXXXXXXXXXXXXXXXXXXXCXCXXXXXXXXXXXXMXXXXXXXXXXXXXXXXXXXXXXXGVFXXXXXXXXFXXXDDLXVXXXSXXXXXXXXXXXGXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXLXXEXXXXFXDXXXXXLXXPLXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67854 - protein, 257 aa, artificial
  consensus sequence
  misc_feature (1)..(96): Xaa can be any naturally occurring amino acid
  misc_feature (98)..(101): Xaa can be any naturally occurring amino acid
  misc_feature (103)..(105): Xaa can be any naturally occurring amino acid
  misc_feature (107)..(114): Xaa can be any naturally occurring amino acid
  misc_feature (123)..(123): Xaa can be any naturally occurring amino acid
  misc_feature (128)..(133): Xaa can be any naturally occurring amino acid
  misc_feature (140)..(145): Xaa can be any naturally occurring amino acid
  misc_feature (149)..(149): Xaa can be any naturally occurring amino acid
  misc_feature (156)..(156): Xaa can be any naturally occurring amino acid
  misc_feature (162)..(162): Xaa can be any naturally occurring amino acid
  misc_feature (165)..(165): Xaa can be any naturally occurring amino acid
  misc_feature (167)..(168): Xaa can be any naturally occurring amino acid
  misc_feature (170)..(170): Xaa can be any naturally occurring amino acid
  misc_feature (172)..(172): Xaa can be any naturally occurring amino acid
  misc_feature (174)..(174): Xaa can be any naturally occurring amino acid
  misc_feature (176)..(176): Xaa can be any naturally occurring amino acid
  misc_feature (178)..(178): Xaa can be any naturally occurring amino acid
  misc_feature (181)..(182): Xaa can be any naturally occurring amino acid
  misc_feature (185)..(186): Xaa can be any naturally occurring amino acid
  misc_feature (188)..(189): Xaa can be any naturally occurring amino acid
  misc_feature (192)..(197): Xaa can be any naturally occurring amino acid
  misc_feature (199)..(199): Xaa can be any naturally occurring amino acid
  misc_feature (202)..(257): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXTXXXGXXXXXXXXALLGLGTQXMYSNXXXXXXALRKLPXXXXXXYMRXHPWEHVXGMGLGXVFXNXXLXKXDXKXKXDLXXMLXXAXXANXXXXXXEXRYXXXXXXXXXXXXXXXXXXXXXXXXXXXXXXXXXXXXXXXXXXXXXXXXXXXXXXXX

SEQ ID NO: 67855 - protein, 376 aa, artificial
  consensus sequence
  misc_feature (1)..(48): Xaa can be any naturally occurring amino acid
  misc_feature (52)..(52): Xaa can be any naturally occurring amino acid
  misc_feature (58)..(59): Xaa can be any naturally occurring amino acid
  misc_feature (62)..(62): Xaa can be any naturally occurring amino acid
  misc_feature (66)..(66): Xaa can be any naturally occurring amino acid
  misc_feature (84)..(84): Xaa can be any naturally occurring amino acid
  misc_feature (90)..(90): Xaa can be any naturally occurring amino acid
  misc_feature (93)..(94): Xaa can be any naturally occurring amino acid
  misc_feature (102)..(145): Xaa can be any naturally occurring amino acid
  misc_feature (147)..(150): Xaa can be any naturally occurring amino acid
  misc_feature (162)..(162): Xaa can be any naturally occurring amino acid
  misc_feature (164)..(166): Xaa can be any naturally occurring amino acid
  misc_feature (168)..(173): Xaa can be any naturally occurring amino acid
  misc_feature (175)..(180): Xaa can be any naturally occurring amino acid
  misc_feature (182)..(183): Xaa can be any naturally occurring amino acid
  misc_feature (187)..(187): Xaa can be any naturally occurring amino acid
  misc_feature (189)..(189): Xaa can be any naturally occurring amino acid
  misc_feature (191)..(191): Xaa can be any naturally occurring amino acid
  misc_feature (193)..(193): Xaa can be any naturally occurring amino acid
  misc_feature (195)..(195): Xaa can be any naturally occurring amino acid
  misc_feature (198)..(201): Xaa can be any naturally occurring amino acid
  misc_feature (203)..(215): Xaa can be any naturally occurring amino acid
  misc_feature (217)..(218): Xaa can be any naturally occurring amino acid
  misc_feature (220)..(222): Xaa can be any naturally occurring amino acid
  misc_feature (224)..(234): Xaa can be any naturally occurring amino acid
  misc_feature (238)..(239): Xaa can be any naturally occurring amino acid
  misc_feature (248)..(248): Xaa can be any naturally occurring amino acid
  misc_feature (250)..(250): Xaa can be any naturally occurring amino acid
  misc_feature (252)..(252): Xaa can be any naturally occurring amino acid
  misc_feature (254)..(255): Xaa can be any naturally occurring amino acid
  misc_feature (270)..(270): Xaa can be any naturally occurring amino acid
  misc_feature (272)..(301): Xaa can be any naturally occurring amino acid
  misc_feature (303)..(308): Xaa can be any naturally occurring amino acid
  misc_feature (310)..(311): Xaa can be any naturally occurring amino acid
  misc_feature (314)..(326): Xaa can be any naturally occurring amino acid
  misc_feature (328)..(330): Xaa can be any naturally occurring amino acid
  misc_feature (332)..(352): Xaa can be any naturally occurring amino acid
  misc_feature (354)..(376): Xaa can be any naturally occurring amino acid
XXXXXXXXXXXXXXXXXXXXXXXXXXXXXXXXXXXXXXXXXXXXXXXXGKRXRDPEEXXVYXDNLXSHKRYLSEIMASSLNGLXVGDSLXDNXXESPARSEXXXXXXXXXXXXXXXXXXXXXXXXXXXXXXXXXXXXXXXXXXXXDXXXXQYSPMSEDSDDXRXXXTXXXXXXSXXXXXXSXXTSPXSXPXRXQXPQXXXXSXXXXXXXXXXXXXCXXSXXXCXXXXXXXXXXXRGSXXEGRFPSSPXDXCXHXXDLRRTALLRSVQMRXQXXXXXXXXXXXXXXXXXXXXXXXXXXXXXXEXXXXXXGXXERXXXXXXXXXXXXXYXXXEXXXXXXXXXXXXXXXXXXXXXLXXXXXXXXXXXXXXXXXXXXXXX

SEQ ID NO: 67856 - protein, 251 aa, artificial
  consensus sequence
  misc_feature (1)..(57): Xaa can be any naturally occurring amino acid
  misc_feature (59)..(66): Xaa can be any naturally occurring amino acid
  misc_feature (68)..(68): Xaa can be any naturally occurring amino acid
  misc_feature (72)..(72): Xaa can be any naturally occurring amino acid
  misc_feature (77)..(77): Xaa can be any naturally occurring amino acid
  misc_feature (80)..(83): Xaa can be any naturally occurring amino acid
  misc_feature (86)..(86): Xaa can be any naturally occurring amino acid
  misc_feature (90)..(90): Xaa can be any naturally occurring amino acid
  misc_feature (92)..(94): Xaa can be any naturally occurring amino acid
  misc_feature (100)..(101): Xaa can be any naturally occurring amino acid
  misc_feature (132)..(132): Xaa can be any naturally occurring amino acid
  misc_feature (135)..(135): Xaa can be any naturally occurring amino acid
  misc_feature (139)..(139): Xaa can be any naturally occurring amino acid
  misc_feature (143)..(175): Xaa can be any naturally occurring amino acid
  misc_feature (216)..(216): Xaa can be any naturally occurring amino acid
  misc_feature (220)..(220): Xaa can be any naturally occurring amino acid
  misc_feature (223)..(223): Xaa can be any naturally occurring amino acid
  misc_feature (228)..(231): Xaa can be any naturally occurring amino acid
  misc_feature (233)..(233): Xaa can be any naturally occurring amino acid
  misc_feature (237)..(239): Xaa can be any naturally occurring amino acid
  misc_feature (241)..(241): Xaa can be any naturally occurring amino acid
  misc_feature (247)..(247): Xaa can be any naturally occurring amino acid
  misc_feature (251)..(251): Xaa can be any naturally occurring amino acid
XXXXXXXXXXXXXXXXXXXXXXXXXXXXXXXXXXXXXXXXXXXXXXXXXXXXXXXXXAXXXXXXXXGXEPAXGIPYXPAXXXXQGXYYYXPXXXPYAAGXXPPNAIYAGAPKGVPLQQTMFRDTPAPFHCQXCGXAAVXSVRXXXXXXXXXXXXXXXXXXXXXXXXXXXXXXXXXSKPSLASVVACMMPFMLGVCFLCPSMDCLWHKYHYCPSCGXEKVXEFXKSDPXXXXCXVVDXXXWXEPSFAXVPAX

SEQ ID NO: 67857 - protein, 977 aa, artificial
  consensus sequence
  misc_feature (1)..(636): Xaa can be any naturally occurring amino acid
  misc_feature (639)..(640): Xaa can be any naturally occurring amino acid
  misc_feature (642)..(652): Xaa can be any naturally occurring amino acid
  misc_feature (655)..(662): Xaa can be any naturally occurring amino acid
  misc_feature (666)..(673): Xaa can be any naturally occurring amino acid
  misc_feature (675)..(684): Xaa can be any naturally occurring amino acid
  misc_feature (686)..(689): Xaa can be any naturally occurring amino acid
  misc_feature (691)..(692): Xaa can be any naturally occurring amino acid
  misc_feature (694)..(707): Xaa can be any naturally occurring amino acid
  misc_feature (710)..(714): Xaa can be any naturally occurring amino acid
  misc_feature (716)..(723): Xaa can be any naturally occurring amino acid
  misc_feature (725)..(726): Xaa can be any naturally occurring amino acid
  misc_feature (728)..(728): Xaa can be any naturally occurring amino acid
  misc_feature (730)..(733): Xaa can be any naturally occurring amino acid
  misc_feature (735)..(750): Xaa can be any naturally occurring amino acid
  misc_feature (752)..(752): Xaa can be any naturally occurring amino acid
  misc_feature (754)..(758): Xaa can be any naturally occurring amino acid
  misc_feature (760)..(761): Xaa can be any naturally occurring amino acid
  misc_feature (763)..(765): Xaa can be any naturally occurring amino acid
  misc_feature (767)..(767): Xaa can be any naturally occurring amino acid
  misc_feature (769)..(769): Xaa can be any naturally occurring amino acid
  misc_feature (771)..(772): Xaa can be any naturally occurring amino acid
  misc_feature (774)..(776): Xaa can be any naturally occurring amino acid
  misc_feature (778)..(783): Xaa can be any naturally occurring amino acid
  misc_feature (789)..(789): Xaa can be any naturally occurring amino acid
  misc_feature (791)..(791): Xaa can be any naturally occurring amino acid
  misc_feature (793)..(794): Xaa can be any naturally occurring amino acid
  misc_feature (796)..(802): Xaa can be any naturally occurring amino acid
  misc_feature (804)..(808): Xaa can be any naturally occurring amino acid
  misc_feature (810)..(812): Xaa can be any naturally occurring amino acid
  misc_feature (814)..(815): Xaa can be any naturally occurring amino acid
  misc_feature (817)..(820): Xaa can be any naturally occurring amino acid
  misc_feature (827)..(828): Xaa can be any naturally occurring amino acid
  misc_feature (831)..(832): Xaa can be any naturally occurring amino acid
  misc_feature (834)..(837): Xaa can be any naturally occurring amino acid
  misc_feature (841)..(841): Xaa can be any naturally occurring amino acid
  misc_feature (843)..(848): Xaa can be any naturally occurring amino acid
  misc_feature (850)..(851): Xaa can be any naturally occurring amino acid
  misc_feature (853)..(857): Xaa can be any naturally occurring amino acid
  misc_feature (859)..(861): Xaa can be any naturally occurring amino acid
  misc_feature (863)..(863): Xaa can be any naturally occurring amino acid
  misc_feature (865)..(885): Xaa can be any naturally occurring amino acid
  misc_feature (887)..(888): Xaa can be any naturally occurring amino acid
  misc_feature (890)..(890): Xaa can be any naturally occurring amino acid
  misc_feature (894)..(895): Xaa can be any naturally occurring amino acid
  misc_feature (897)..(903): Xaa can be any naturally occurring amino acid
  misc_feature (905)..(909): Xaa can be any naturally occurring amino acid
  misc_feature (911)..(915): Xaa can be any naturally occurring amino acid
  misc_feature (917)..(920): Xaa can be any naturally occurring amino acid
  misc_feature (922)..(926): Xaa can be any naturally occurring amino acid
  misc_feature (929)..(934): Xaa can be any naturally occurring amino acid
  misc_feature (936)..(938): Xaa can be any naturally occurring amino acid
  misc_feature (941)..(944): Xaa can be any naturally occurring amino acid
  misc_feature (947)..(947): Xaa can be any naturally occurring amino acid
  misc_feature (951)..(951): Xaa can be any naturally occurring amino acid
  misc_feature (954)..(954): Xaa can be any naturally occurring amino acid
  misc_feature (958)..(977): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLXXEXXXXXXXXXXXLKXXXXXXXXSDEXXXXXXXXEXXXXXXXXXXLXXXXLXXGXXXXXXXXXXXXXXELXXXXXEXXXXXXXXEXXLXEXXXXAXXXXXXXXXXXXXXXXLXKXXXXXLXXLXXXSXEXQXXYXXXWXXXXXXCAQELXHXAXXWXXXXXXXVXXXXXSXXXGXXYXXXXGEIYRVXXILXXSXXXXKPWXLXXXXXXSXXLXXXXXCXXXWXSXXXXXXXXXXXXXXXXXXXXXAXXLXESIXXIXXXXXXXLXXXXXSXXXXXCXXXXLXXXXXPGXXXXXXWXXXHYXXXXANXWANXISXDPPXXXXXXXXXXXXXXXXXXXX

SEQ ID NO: 67858 - protein, 317 aa, artificial
  consensus sequence
  misc_feature (1)..(1): Xaa can be any naturally occurring amino acid
  misc_feature (4)..(9): Xaa can be any naturally occurring amino acid
  misc_feature (15)..(15): Xaa can be any naturally occurring amino acid
  misc_feature (27)..(30): Xaa can be any naturally occurring amino acid
  misc_feature (41)..(41): Xaa can be any naturally occurring amino acid
  misc_feature (52)..(53): Xaa can be any naturally occurring amino acid
  misc_feature (57)..(57): Xaa can be any naturally occurring amino acid
  misc_feature (60)..(60): Xaa can be any naturally occurring amino acid
  misc_feature (63)..(63): Xaa can be any naturally occurring amino acid
  misc_feature (69)..(69): Xaa can be any naturally occurring amino acid
  misc_feature (71)..(84): Xaa can be any naturally occurring amino acid
  misc_feature (87)..(87): Xaa can be any naturally occurring amino acid
  misc_feature (89)..(89): Xaa can be any naturally occurring amino acid
  misc_feature (102)..(102): Xaa can be any naturally occurring amino acid
  misc_feature (104)..(104): Xaa can be any naturally occurring amino acid
  misc_feature (111)..(112): Xaa can be any naturally occurring amino acid
  misc_feature (114)..(114): Xaa can be any naturally occurring amino acid
  misc_feature (117)..(117): Xaa can be any naturally occurring amino acid
  misc_feature (122)..(122): Xaa can be any naturally occurring amino acid
  misc_feature (125)..(125): Xaa can be any naturally occurring amino acid
  misc_feature (128)..(131): Xaa can be any naturally occurring amino acid
  misc_feature (134)..(140): Xaa can be any naturally occurring amino acid
  misc_feature (142)..(146): Xaa can be any naturally occurring amino acid
  misc_feature (152)..(153): Xaa can be any naturally occurring amino acid
  misc_feature (155)..(156): Xaa can be any naturally occurring amino acid
  misc_feature (167)..(167): Xaa can be any naturally occurring amino acid
  misc_feature (173)..(173): Xaa can be any naturally occurring amino acid
  misc_feature (178)..(178): Xaa can be any naturally occurring amino acid
  misc_feature (180)..(182): Xaa can be any naturally occurring amino acid
  misc_feature (186)..(186): Xaa can be any naturally occurring amino acid
  misc_feature (188)..(190): Xaa can be any naturally occurring amino acid
  misc_feature (192)..(197): Xaa can be any naturally occurring amino acid
  misc_feature (199)..(199): Xaa can be any naturally occurring amino acid
  misc_feature (201)..(202): Xaa can be any naturally occurring amino acid
  misc_feature (207)..(207): Xaa can be any naturally occurring amino acid
  misc_feature (212)..(212): Xaa can be any naturally occurring amino acid
  misc_feature (216)..(216): Xaa can be any naturally occurring amino acid
  misc_feature (218)..(220): Xaa can be any naturally occurring amino acid
  misc_feature (222)..(222): Xaa can be any naturally occurring amino acid
  misc_feature (225)..(226): Xaa can be any naturally occurring amino acid
  misc_feature (232)..(243): Xaa can be any naturally occurring amino acid
  misc_feature (245)..(246): Xaa can be any naturally occurring amino acid
  misc_feature (253)..(253): Xaa can be any naturally occurring amino acid
  misc_feature (256)..(257): Xaa can be any naturally occurring amino acid
  misc_feature (260)..(264): Xaa can be any naturally occurring amino acid
  misc_feature (266)..(317): Xaa can be any naturally occurring amino acid
XMAXXXXXXGAALFXEEELRDVSGVRXXXXFVEVTCGCTSXRYGDAVGRLRXXASGXLEXSCXCTPGCXEXXXXXXXXXXXXXXKLXPXAFEKHSGRETAGXWXNTVWVMXXGXKVXLSKTXLLXYYXXXXKSXXXXXXXRXXXXXHRDEFXXCXXCGKERRFRLRXKEECRXYHDAXAXXXWTCXDXXXDXXXXXXVXCXXEEERXSRKVXRGCXRXXXCXGCXXCVCFGXXXXXXXXXXXXCXXCRFTDCXCQXXVDXXXXXKXXXXXXXXXXXXXXXXXXXXXXXXXXXXXXXXXXXXXXXXXXXXXXXXXXXX

SEQ ID NO: 67859 - protein, 212 aa, artificial
  consensus sequence
  misc_feature (1)..(12): Xaa can be any naturally occurring amino acid
  misc_feature (14)..(14): Xaa can be any naturally occurring amino acid
  misc_feature (16)..(26): Xaa can be any naturally occurring amino acid
  misc_feature (28)..(43): Xaa can be any naturally occurring amino acid
  misc_feature (47)..(47): Xaa can be any naturally occurring amino acid
  misc_feature (65)..(65): Xaa can be any naturally occurring amino acid
  misc_feature (69)..(71): Xaa can be any naturally occurring amino acid
  misc_feature (76)..(100): Xaa can be any naturally occurring amino acid
  misc_feature (105)..(105): Xaa can be any naturally occurring amino acid
  misc_feature (111)..(111): Xaa can be any naturally occurring amino acid
  misc_feature (118)..(119): Xaa can be any naturally occurring amino acid
  misc_feature (121)..(124): Xaa can be any naturally occurring amino acid
  misc_feature (126)..(169): Xaa can be any naturally occurring amino acid
  misc_feature (171)..(172): Xaa can be any naturally occurring amino acid
  misc_feature (178)..(181): Xaa can be any naturally occurring amino acid
  misc_feature (185)..(185): Xaa can be any naturally occurring amino acid
  misc_feature (187)..(189): Xaa can be any naturally occurring amino acid
  misc_feature (191)..(195): Xaa can be any naturally occurring amino acid
  misc_feature (197)..(203): Xaa can be any naturally occurring amino acid
  misc_feature (206)..(212): Xaa can be any naturally occurring amino acid
XXXXXXXXXXXXPXPXXXXXXXXXXXPXXXXXXXXXXXXXXXXACVXALEAALLPCLPARELQAXDRSXXXSHQIXXXXXXXXXXXXXXXXXXXXXXXXXDVERXARDFMXAAKKLQXXFXXXXRXXXXXXXXXXXXXXXXXXXXXXXXXXXXXXXXXXXXXXXXXXXXIXXMEEELXXXXELIXKXXXLXXXXXKXXXXXXXKHXXXXXXX

SEQ ID NO: 67860 - protein, 577 aa, artificial
  consensus sequence
  misc_feature (1)..(340): Xaa can be any naturally occurring amino acid
  misc_feature (342)..(344): Xaa can be any naturally occurring amino acid
  misc_feature (347)..(348): Xaa can be any naturally occurring amino acid
  misc_feature (350)..(350): Xaa can be any naturally occurring amino acid
  misc_feature (357)..(357): Xaa can be any naturally occurring amino acid
  misc_feature (366)..(366): Xaa can be any naturally occurring amino acid
  misc_feature (371)..(372): Xaa can be any naturally occurring amino acid
  misc_feature (380)..(382): Xaa can be any naturally occurring amino acid
  misc_feature (385)..(385): Xaa can be any naturally occurring amino acid
  misc_feature (387)..(387): Xaa can be any naturally occurring amino acid
  misc_feature (400)..(400): Xaa can be any naturally occurring amino acid
  misc_feature (407)..(407): Xaa can be any naturally occurring amino acid
  misc_feature (411)..(411): Xaa can be any naturally occurring amino acid
  misc_feature (413)..(522): Xaa can be any naturally occurring amino acid
  misc_feature (525)..(525): Xaa can be any naturally occurring amino acid
  misc_feature (530)..(530): Xaa can be any naturally occurring amino acid
  misc_feature (532)..(532): Xaa can be any naturally occurring amino acid
  misc_feature (534)..(577): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXDEXXRXKQAEKKXRRLEKALAXSAAIXXELEKKKQXXXEEXQXRLDEEGAAIAEAXVALHVLXGEDXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAAXQAVSXLXIXXXXXXXXXXXXXXXXXXXXXXXXXXXXXXXXXXXXXXXXXXXX

SEQ ID NO: 67861 - protein, 387 aa, artificial
  consensus sequence
  misc_feature (1)..(166): Xaa can be any naturally occurring amino acid
  misc_feature (169)..(169): Xaa can be any naturally occurring amino acid
  misc_feature (171)..(172): Xaa can be any naturally occurring amino acid
  misc_feature (174)..(177): Xaa can be any naturally occurring amino acid
  misc_feature (179)..(185): Xaa can be any naturally occurring amino acid
  misc_feature (187)..(204): Xaa can be any naturally occurring amino acid
  misc_feature (208)..(213): Xaa can be any naturally occurring amino acid
  misc_feature (215)..(215): Xaa can be any naturally occurring amino acid
  misc_feature (217)..(229): Xaa can be any naturally occurring amino acid
  misc_feature (233)..(234): Xaa can be any naturally occurring amino acid
  misc_feature (236)..(236): Xaa can be any naturally occurring amino acid
  misc_feature (239)..(255): Xaa can be any naturally occurring amino acid
  misc_feature (257)..(258): Xaa can be any naturally occurring amino acid
  misc_feature (260)..(265): Xaa can be any naturally occurring amino acid
  misc_feature (267)..(279): Xaa can be any naturally occurring amino acid
  misc_feature (281)..(288): Xaa can be any naturally occurring amino acid
  misc_feature (290)..(290): Xaa can be any naturally occurring amino acid
  misc_feature (292)..(293): Xaa can be any naturally occurring amino acid
  misc_feature (295)..(331): Xaa can be any naturally occurring amino acid
  misc_feature (333)..(356): Xaa can be any naturally occurring amino acid
  misc_feature (358)..(387): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVEXAXXAXXXXLXXXXXXXLXXXXXXXXXXXXXXXXXXPLPXXXXXXRXGXXXXXXXXXXXXXLLLXXLXGPXXXXXXXXXXXXXXXXXGXXWXXXXXXWXXXXXXXXXXXXXGXXXXXXXXSXLXXEXXXXXXXXXXXXXXXXXXXXXXXXXXXXXXXXXXXXXPXXXXXXXXXXXXXXXXXXXXXXXXHXXXXXXXXXXXXXXXXXXXXXXXXXXXXXX

SEQ ID NO: 67862 - protein, 205 aa, artificial
  consensus sequence
  misc_feature (1)..(1): Xaa can be any naturally occurring amino acid
  misc_feature (7)..(10): Xaa can be any naturally occurring amino acid
  misc_feature (18)..(18): Xaa can be any naturally occurring amino acid
  misc_feature (20)..(20): Xaa can be any naturally occurring amino acid
  misc_feature (26)..(27): Xaa can be any naturally occurring amino acid
  misc_feature (31)..(33): Xaa can be any naturally occurring amino acid
  misc_feature (35)..(36): Xaa can be any naturally occurring amino acid
  misc_feature (38)..(38): Xaa can be any naturally occurring amino acid
  misc_feature (41)..(41): Xaa can be any naturally occurring amino acid
  misc_feature (43)..(44): Xaa can be any naturally occurring amino acid
  misc_feature (48)..(50): Xaa can be any naturally occurring amino acid
  misc_feature (55)..(56): Xaa can be any naturally occurring amino acid
  misc_feature (63)..(63): Xaa can be any naturally occurring amino acid
  misc_feature (66)..(68): Xaa can be any naturally occurring amino acid
  misc_feature (75)..(75): Xaa can be any naturally occurring amino acid
  misc_feature (79)..(79): Xaa can be any naturally occurring amino acid
  misc_feature (86)..(86): Xaa can be any naturally occurring amino acid
  misc_feature (89)..(108): Xaa can be any naturally occurring amino acid
  misc_feature (110)..(133): Xaa can be any naturally occurring amino acid
  misc_feature (136)..(151): Xaa can be any naturally occurring amino acid
  misc_feature (153)..(154): Xaa can be any naturally occurring amino acid
  misc_feature (156)..(166): Xaa can be any naturally occurring amino acid
  misc_feature (168)..(191): Xaa can be any naturally occurring amino acid
  misc_feature (193)..(193): Xaa can be any naturally occurring amino acid
  misc_feature (198)..(198): Xaa can be any naturally occurring amino acid
  misc_feature (200)..(205): Xaa can be any naturally occurring amino acid
XMVLWEXXXXTAYFLGLXRXYRLALXXQRRXXXPXXPXIRXFXXRRTXXXFDVAXXVHKNIQXRDXXXGRNLGNXILRXLDRMKPXAQXXXXXXXXXXXXXXXXXXXXLXXXXXXXXXXXXXXXXXXXXXXXXLFXXXXXXXXXXXXXXXXMXXPXXXXXXXXXXXRXXXXXXXXXXXXXXXXXXXXXXXXVXRKDIXQXXXXXX

SEQ ID NO: 67863 - protein, 267 aa, artificial
  consensus sequence
  misc_feature (1)..(25): Xaa can be any naturally occurring amino acid
  misc_feature (27)..(27): Xaa can be any naturally occurring amino acid
  misc_feature (29)..(33): Xaa can be any naturally occurring amino acid
  misc_feature (35)..(36): Xaa can be any naturally occurring amino acid
  misc_feature (39)..(39): Xaa can be any naturally occurring amino acid
  misc_feature (41)..(42): Xaa can be any naturally occurring amino acid
  misc_feature (44)..(44): Xaa can be any naturally occurring amino acid
  misc_feature (51)..(51): Xaa can be any naturally occurring amino acid
  misc_feature (66)..(66): Xaa can be any naturally occurring amino acid
  misc_feature (69)..(70): Xaa can be any naturally occurring amino acid
  misc_feature (73)..(73): Xaa can be any naturally occurring amino acid
  misc_feature (77)..(77): Xaa can be any naturally occurring amino acid
  misc_feature (83)..(85): Xaa can be any naturally occurring amino acid
  misc_feature (87)..(88): Xaa can be any naturally occurring amino acid
  misc_feature (94)..(94): Xaa can be any naturally occurring amino acid
  misc_feature (104)..(105): Xaa can be any naturally occurring amino acid
  misc_feature (107)..(108): Xaa can be any naturally occurring amino acid
  misc_feature (110)..(110): Xaa can be any naturally occurring amino acid
  misc_feature (113)..(115): Xaa can be any naturally occurring amino acid
  misc_feature (121)..(122): Xaa can be any naturally occurring amino acid
  misc_feature (124)..(126): Xaa can be any naturally occurring amino acid
  misc_feature (131)..(132): Xaa can be any naturally occurring amino acid
  misc_feature (134)..(134): Xaa can be any naturally occurring amino acid
  misc_feature (136)..(136): Xaa can be any naturally occurring amino acid
  misc_feature (138)..(138): Xaa can be any naturally occurring amino acid
  misc_feature (140)..(140): Xaa can be any naturally occurring amino acid
  misc_feature (142)..(142): Xaa can be any naturally occurring amino acid
  misc_feature (144)..(144): Xaa can be any naturally occurring amino acid
  misc_feature (146)..(147): Xaa can be any naturally occurring amino acid
  misc_feature (152)..(152): Xaa can be any naturally occurring amino acid
  misc_feature (159)..(159): Xaa can be any naturally occurring amino acid
  misc_feature (163)..(176): Xaa can be any naturally occurring amino acid
  misc_feature (178)..(181): Xaa can be any naturally occurring amino acid
  misc_feature (184)..(184): Xaa can be any naturally occurring amino acid
  misc_feature (187)..(188): Xaa can be any naturally occurring amino acid
  misc_feature (191)..(191): Xaa can be any naturally occurring amino acid
  misc_feature (195)..(222): Xaa can be any naturally occurring amino acid
  misc_feature (224)..(233): Xaa can be any naturally occurring amino acid
  misc_feature (235)..(267): Xaa can be any naturally occurring amino acid
XXXXXXXXXXXXXXXXXXXXXXXXXRXGXXXXXNXXAWXPXXGXKINETEXGGRFRPLSEITGVCXRCXXQIXWKRXYGKYKXXXEXXKCQKCXKRNVRQAYHXXCXXCXKEXXXCAKCCXXVXXXVGRDXXEXEXEXKXLXEXIXXARERXRRTLLRXMNKXXXXXXXXXXXXXXDXXXXGDXFPXXSLXEYAXXXXXXXXXXXXXXXXXXXXXXXXXXXXDXXXXXXXXXXDXXXXXXXXXXXXXXXXXXXXXXXXXXXXXXXXX

SEQ ID NO: 67864 - protein, 222 aa, artificial
  consensus sequence
  misc_feature (1)..(74): Xaa can be any naturally occurring amino acid
  misc_feature (77)..(87): Xaa can be any naturally occurring amino acid
  misc_feature (89)..(90): Xaa can be any naturally occurring amino acid
  misc_feature (93)..(129): Xaa can be any naturally occurring amino acid
  misc_feature (136)..(136): Xaa can be any naturally occurring amino acid
  misc_feature (141)..(142): Xaa can be any naturally occurring amino acid
  misc_feature (145)..(146): Xaa can be any naturally occurring amino acid
  misc_feature (148)..(175): Xaa can be any naturally occurring amino acid
  misc_feature (177)..(177): Xaa can be any naturally occurring amino acid
  misc_feature (185)..(185): Xaa can be any naturally occurring amino acid
  misc_feature (188)..(188): Xaa can be any naturally occurring amino acid
  misc_feature (191)..(191): Xaa can be any naturally occurring amino acid
  misc_feature (211)..(222): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXMAXXXXXXXXXXXFXXRPXXXXXXXXXXXXXXXXXXXXXXXXXXXXXXXXXXXXXKWWAPLXGWSGXXDYXXAXXXXXXXXXXXXXXXXXXXXXXXXXXXXGXLTEEKARXLRXRMXETESFHDAMYHSAIASRLAXXXXXXXXXXXX

SEQ ID NO: 67865 - protein, 495 aa, artificial
  consensus sequence
  misc_feature (1)..(72): Xaa can be any naturally occurring amino acid
  misc_feature (74)..(74): Xaa can be any naturally occurring amino acid
  misc_feature (76)..(76): Xaa can be any naturally occurring amino acid
  misc_feature (78)..(83): Xaa can be any naturally occurring amino acid
  misc_feature (85)..(86): Xaa can be any naturally occurring amino acid
  misc_feature (92)..(93): Xaa can be any naturally occurring amino acid
  misc_feature (100)..(100): Xaa can be any naturally occurring amino acid
  misc_feature (110)..(110): Xaa can be any naturally occurring amino acid
  misc_feature (124)..(124): Xaa can be any naturally occurring amino acid
  misc_feature (130)..(132): Xaa can be any naturally occurring amino acid
  misc_feature (135)..(135): Xaa can be any naturally occurring amino acid
  misc_feature (143)..(143): Xaa can be any naturally occurring amino acid
  misc_feature (150)..(495): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXAXKXGXXXXXXVXXGCKTCXXKGAVECXGCKGTGRNKXKNGNIFERWKCFDXCQGFGXXXCPXCGKGGLTXPEQRGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67866 - protein, 526 aa, artificial
  consensus sequence
  misc_feature (1)..(49): Xaa can be any naturally occurring amino acid
  misc_feature (51)..(65): Xaa can be any naturally occurring amino acid
  misc_feature (67)..(67): Xaa can be any naturally occurring amino acid
  misc_feature (70)..(89): Xaa can be any naturally occurring amino acid
  misc_feature (91)..(91): Xaa can be any naturally occurring amino acid
  misc_feature (93)..(145): Xaa can be any naturally occurring amino acid
  misc_feature (148)..(151): Xaa can be any naturally occurring amino acid
  misc_feature (155)..(155): Xaa can be any naturally occurring amino acid
  misc_feature (159)..(159): Xaa can be any naturally occurring amino acid
  misc_feature (161)..(164): Xaa can be any naturally occurring amino acid
  misc_feature (166)..(171): Xaa can be any naturally occurring amino acid
  misc_feature (173)..(174): Xaa can be any naturally occurring amino acid
  misc_feature (177)..(178): Xaa can be any naturally occurring amino acid
  misc_feature (180)..(180): Xaa can be any naturally occurring amino acid
  misc_feature (186)..(187): Xaa can be any naturally occurring amino acid
  misc_feature (189)..(190): Xaa can be any naturally occurring amino acid
  misc_feature (192)..(192): Xaa can be any naturally occurring amino acid
  misc_feature (194)..(196): Xaa can be any naturally occurring amino acid
  misc_feature (199)..(201): Xaa can be any naturally occurring amino acid
  misc_feature (205)..(206): Xaa can be any naturally occurring amino acid
  misc_feature (208)..(210): Xaa can be any naturally occurring amino acid
  misc_feature (213)..(218): Xaa can be any naturally occurring amino acid
  misc_feature (221)..(222): Xaa can be any naturally occurring amino acid
  misc_feature (225)..(226): Xaa can be any naturally occurring amino acid
  misc_feature (228)..(229): Xaa can be any naturally occurring amino acid
  misc_feature (232)..(232): Xaa can be any naturally occurring amino acid
  misc_feature (236)..(240): Xaa can be any naturally occurring amino acid
  misc_feature (243)..(255): Xaa can be any naturally occurring amino acid
  misc_feature (257)..(264): Xaa can be any naturally occurring amino acid
  misc_feature (269)..(269): Xaa can be any naturally occurring amino acid
  misc_feature (271)..(271): Xaa can be any naturally occurring amino acid
  misc_feature (273)..(297): Xaa can be any naturally occurring amino acid
  misc_feature (299)..(303): Xaa can be any naturally occurring amino acid
  misc_feature (305)..(330): Xaa can be any naturally occurring amino acid
  misc_feature (332)..(356): Xaa can be any naturally occurring amino acid
  misc_feature (358)..(363): Xaa can be any naturally occurring amino acid
  misc_feature (366)..(388): Xaa can be any naturally occurring amino acid
  misc_feature (390)..(392): Xaa can be any naturally occurring amino acid
  misc_feature (395)..(395): Xaa can be any naturally occurring amino acid
  misc_feature (397)..(399): Xaa can be any naturally occurring amino acid
  misc_feature (401)..(407): Xaa can be any naturally occurring amino acid
  misc_feature (409)..(409): Xaa can be any naturally occurring amino acid
  misc_feature (412)..(449): Xaa can be any naturally occurring amino acid
  misc_feature (451)..(451): Xaa can be any naturally occurring amino acid
  misc_feature (455)..(470): Xaa can be any naturally occurring amino acid
  misc_feature (472)..(483): Xaa can be any naturally occurring amino acid
  misc_feature (485)..(526): Xaa can be any naturally occurring amino acid
XXXXXXXXXXXXXXXXXXXXXXXXXXXXXXXXXXXXXXXXXXXXXXXXXNXXXXXXXXXXXXXXXNXEQXXXXXXXXXXXXXXXXXXXXRXPXXXXXXXXXXXXXXXXXXXXXXXXXXXXXXXXXXXXXXXXXXXXXXXXXXXXXDLXXXXYFGXLFDXKXXXXFXXXXXXRXXERXXCXTYDYVXXDXXDXLXXXDLXXXSALXXLXXXRPXXXXXXSHXXALXXCXXHAXLWLXXXXXPIXXXXXXXXXXXXXAXXXXXXXXIMASXYXTXXXXXXXXXXXXXXXXXXXXXXXXXQXXXXXSXXXXXXXXXXXXXXXXXXXXXXXXXXEXXXXXXXXXXXXXXXXXXXXXXXXXEXXXXXXEQXXXXXXXXXXXXXXXXXXXXXXXRXXXQNXRXXXGXXXXXXXYXNGXXXXXXXXXXXXXXXXXXXXXXXXXXXXXXXXXXXXXXYXNGRXXXXXXXXXXXXXXXXYXXXXXXXXXXXXGXXXXXXXXXXXXXXXXXXXXXXXXXXXXXXXXXXXXXXXXXX

SEQ ID NO: 67867 - protein, 385 aa, artificial
  consensus sequence
  misc_feature (1)..(126): Xaa can be any naturally occurring amino acid
  misc_feature (128)..(128): Xaa can be any naturally occurring amino acid
  misc_feature (130)..(130): Xaa can be any naturally occurring amino acid
  misc_feature (133)..(135): Xaa can be any naturally occurring amino acid
  misc_feature (137)..(137): Xaa can be any naturally occurring amino acid
  misc_feature (140)..(151): Xaa can be any naturally occurring amino acid
  misc_feature (153)..(154): Xaa can be any naturally occurring amino acid
  misc_feature (156)..(156): Xaa can be any naturally occurring amino acid
  misc_feature (158)..(158): Xaa can be any naturally occurring amino acid
  misc_feature (160)..(161): Xaa can be any naturally occurring amino acid
  misc_feature (164)..(166): Xaa can be any naturally occurring amino acid
  misc_feature (168)..(173): Xaa can be any naturally occurring amino acid
  misc_feature (175)..(175): Xaa can be any naturally occurring amino acid
  misc_feature (178)..(178): Xaa can be any naturally occurring amino acid
  misc_feature (180)..(180): Xaa can be any naturally occurring amino acid
  misc_feature (182)..(182): Xaa can be any naturally occurring amino acid
  misc_feature (185)..(187): Xaa can be any naturally occurring amino acid
  misc_feature (189)..(191): Xaa can be any naturally occurring amino acid
  misc_feature (193)..(198): Xaa can be any naturally occurring amino acid
  misc_feature (202)..(202): Xaa can be any naturally occurring amino acid
  misc_feature (205)..(210): Xaa can be any naturally occurring amino acid
  misc_feature (213)..(213): Xaa can be any naturally occurring amino acid
  misc_feature (216)..(218): Xaa can be any naturally occurring amino acid
  misc_feature (221)..(229): Xaa can be any naturally occurring amino acid
  misc_feature (231)..(234): Xaa can be any naturally occurring amino acid
  misc_feature (239)..(240): Xaa can be any naturally occurring amino acid
  misc_feature (242)..(249): Xaa can be any naturally occurring amino acid
  misc_feature (252)..(252): Xaa can be any naturally occurring amino acid
  misc_feature (254)..(256): Xaa can be any naturally occurring amino acid
  misc_feature (261)..(263): Xaa can be any naturally occurring amino acid
  misc_feature (265)..(265): Xaa can be any naturally occurring amino acid
  misc_feature (269)..(269): Xaa can be any naturally occurring amino acid
  misc_feature (273)..(275): Xaa can be any naturally occurring amino acid
  misc_feature (278)..(288): Xaa can be any naturally occurring amino acid
  misc_feature (291)..(291): Xaa can be any naturally occurring amino acid
  misc_feature (298)..(347): Xaa can be any naturally occurring amino acid
  misc_feature (349)..(358): Xaa can be any naturally occurring amino acid
  misc_feature (360)..(363): Xaa can be any naturally occurring amino acid
  misc_feature (365)..(367): Xaa can be any naturally occurring amino acid
  misc_feature (369)..(371): Xaa can be any naturally occurring amino acid
  misc_feature (373)..(374): Xaa can be any naturally occurring amino acid
  misc_feature (376)..(376): Xaa can be any naturally occurring amino acid
  misc_feature (378)..(385): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXLXLDXXXNXHSXXXXXXXXXXXXTXXYXDXFXXLPXXXPXXXXXXAXLGXGXGXAAXXXLXXXPXXXXXXGWEXDPXXXXXXRDXFGXXXLEXXXXXXXXXLXXXXGDALXXSXXXXXXXXGFXGXXXVDLFXXXGXVLPXLQEXXXTWXXXXXXXXXXXGRXMVNCGGXXXXXXXXXXXXXXXXXXXXXXXXXXXXXXXXXXXXXXXXXXXXXXXXXXAXXXXXXXXXXWXXXXPXXXLXXXVXXWXPXXXXXXXX

SEQ ID NO: 67868 - protein, 1044 aa, artificial
  consensus sequence
  misc_feature (1)..(147): Xaa can be any naturally occurring amino acid
  misc_feature (149)..(152): Xaa can be any naturally occurring amino acid
  misc_feature (154)..(155): Xaa can be any naturally occurring amino acid
  misc_feature (158)..(159): Xaa can be any naturally occurring amino acid
  misc_feature (161)..(194): Xaa can be any naturally occurring amino acid
  misc_feature (196)..(198): Xaa can be any naturally occurring amino acid
  misc_feature (200)..(202): Xaa can be any naturally occurring amino acid
  misc_feature (204)..(214): Xaa can be any naturally occurring amino acid
  misc_feature (216)..(217): Xaa can be any naturally occurring amino acid
  misc_feature (219)..(231): Xaa can be any naturally occurring amino acid
  misc_feature (233)..(236): Xaa can be any naturally occurring amino acid
  misc_feature (238)..(270): Xaa can be any naturally occurring amino acid
  misc_feature (272)..(319): Xaa can be any naturally occurring amino acid
  misc_feature (321)..(375): Xaa can be any naturally occurring amino acid
  misc_feature (379)..(396): Xaa can be any naturally occurring amino acid
  misc_feature (398)..(400): Xaa can be any naturally occurring amino acid
  misc_feature (402)..(409): Xaa can be any naturally occurring amino acid
  misc_feature (411)..(413): Xaa can be any naturally occurring amino acid
  misc_feature (415)..(416): Xaa can be any naturally occurring amino acid
  misc_feature (418)..(422): Xaa can be any naturally occurring amino acid
  misc_feature (424)..(426): Xaa can be any naturally occurring amino acid
  misc_feature (428)..(428): Xaa can be any naturally occurring amino acid
  misc_feature (432)..(1044): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXVXXAVXXLXXXXXXXXXXXXXXXXXXXXXXXXXXXXXXXXXXLXXXLXXXPXXXXXXXXXXXPXXHXXXXXXXXXXXXXCXXXXDXXXXXXXXXXXXXXXXXXXXXXXXXXXXXXXXXLXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXGTCXXXXXXXXXXXXXXXXXXNXXXAXXXXXXXXVXXXWXXVXXXXXKXXXSXALPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67869 - protein, 485 aa, artificial
  consensus sequence
  misc_feature (1)..(97): Xaa can be any naturally occurring amino acid
  misc_feature (99)..(133): Xaa can be any naturally occurring amino acid
  misc_feature (135)..(158): Xaa can be any naturally occurring amino acid
  misc_feature (163)..(168): Xaa can be any naturally occurring amino acid
  misc_feature (170)..(170): Xaa can be any naturally occurring amino acid
  misc_feature (173)..(187): Xaa can be any naturally occurring amino acid
  misc_feature (189)..(201): Xaa can be any naturally occurring amino acid
  misc_feature (203)..(207): Xaa can be any naturally occurring amino acid
  misc_feature (209)..(213): Xaa can be any naturally occurring amino acid
  misc_feature (215)..(221): Xaa can be any naturally occurring amino acid
  misc_feature (223)..(263): Xaa can be any naturally occurring amino acid
  misc_feature (265)..(274): Xaa can be any naturally occurring amino acid
  misc_feature (276)..(277): Xaa can be any naturally occurring amino acid
  misc_feature (279)..(280): Xaa can be any naturally occurring amino acid
  misc_feature (283)..(283): Xaa can be any naturally occurring amino acid
  misc_feature (286)..(287): Xaa can be any naturally occurring amino acid
  misc_feature (289)..(292): Xaa can be any naturally occurring amino acid
  misc_feature (294)..(294): Xaa can be any naturally occurring amino acid
  misc_feature (296)..(297): Xaa can be any naturally occurring amino acid
  misc_feature (300)..(304): Xaa can be any naturally occurring amino acid
  misc_feature (306)..(306): Xaa can be any naturally occurring amino acid
  misc_feature (308)..(308): Xaa can be any naturally occurring amino acid
  misc_feature (310)..(312): Xaa can be any naturally occurring amino acid
  misc_feature (314)..(316): Xaa can be any naturally occurring amino acid
  misc_feature (318)..(318): Xaa can be any naturally occurring amino acid
  misc_feature (322)..(324): Xaa can be any naturally occurring amino acid
  misc_feature (326)..(326): Xaa can be any naturally occurring amino acid
  misc_feature (329)..(330): Xaa can be any naturally occurring amino acid
  misc_feature (332)..(332): Xaa can be any naturally occurring amino acid
  misc_feature (334)..(355): Xaa can be any naturally occurring amino acid
  misc_feature (358)..(358): Xaa can be any naturally occurring amino acid
  misc_feature (363)..(363): Xaa can be any naturally occurring amino acid
  misc_feature (365)..(366): Xaa can be any naturally occurring amino acid
  misc_feature (368)..(401): Xaa can be any naturally occurring amino acid
  misc_feature (403)..(404): Xaa can be any naturally occurring amino acid
  misc_feature (406)..(412): Xaa can be any naturally occurring amino acid
  misc_feature (414)..(415): Xaa can be any naturally occurring amino acid
  misc_feature (418)..(418): Xaa can be any naturally occurring amino acid
  misc_feature (421)..(421): Xaa can be any naturally occurring amino acid
  misc_feature (424)..(425): Xaa can be any naturally occurring amino acid
  misc_feature (427)..(434): Xaa can be any naturally occurring amino acid
  misc_feature (437)..(449): Xaa can be any naturally occurring amino acid
  misc_feature (451)..(453): Xaa can be any naturally occurring amino acid
  misc_feature (455)..(485): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXLXXXXXXXXXXXXXXXXXXXXXXXXVSTGXXXXXXLXLSXXXXXXXXXXXXXXXSXXXXXXXXXXXXXDXXXXXLXXXXXEXXXXXXXQXXXXXXXXXXXXXXXXXXXXXXXXXXXXXXXXXXXXXXXXXQXXXXXXXXXXEXXVXXKLXEKXXEXXXXNXKXXELXXXXXQXAXEXXXWXXXAXYNEXXXNXLKXXLXQXXXXXXXXXXXXXXXXXXXXXXEGXGDSEXDXXAXXXXXXXXXXXXXXXXXXXXXXXXXXXXXXXXXXCXXCXXXXXXXLXXPCXHLXLCXXCXXXXXXXXCPXXXXXXXXXXXXXCXXXKXXXXXXXXXXXXXXXXXXXXXXXXXXXXXXX

SEQ ID NO: 67870 - protein, 399 aa, artificial
  consensus sequence
  misc_feature (1)..(171): Xaa can be any naturally occurring amino acid
  misc_feature (173)..(203): Xaa can be any naturally occurring amino acid
  misc_feature (205)..(206): Xaa can be any naturally occurring amino acid
  misc_feature (209)..(209): Xaa can be any naturally occurring amino acid
  misc_feature (211)..(213): Xaa can be any naturally occurring amino acid
  misc_feature (217)..(217): Xaa can be any naturally occurring amino acid
  misc_feature (220)..(220): Xaa can be any naturally occurring amino acid
  misc_feature (224)..(224): Xaa can be any naturally occurring amino acid
  misc_feature (229)..(230): Xaa can be any naturally occurring amino acid
  misc_feature (232)..(232): Xaa can be any naturally occurring amino acid
  misc_feature (235)..(235): Xaa can be any naturally occurring amino acid
  misc_feature (238)..(238): Xaa can be any naturally occurring amino acid
  misc_feature (240)..(242): Xaa can be any naturally occurring amino acid
  misc_feature (247)..(248): Xaa can be any naturally occurring amino acid
  misc_feature (250)..(399): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXCXXSCXAXXXADCXALXCCPXCAVVXXLXLAXVKXPXXXGRRCXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67871 - protein, 1681 aa, artificial
  consensus sequence
  misc_feature (1)..(908): Xaa can be any naturally occurring amino acid
  misc_feature (911)..(931): Xaa can be any naturally occurring amino acid
  misc_feature (934)..(938): Xaa can be any naturally occurring amino acid
  misc_feature (941)..(941): Xaa can be any naturally occurring amino acid
  misc_feature (943)..(944): Xaa can be any naturally occurring amino acid
  misc_feature (946)..(974): Xaa can be any naturally occurring amino acid
  misc_feature (976)..(977): Xaa can be any naturally occurring amino acid
  misc_feature (979)..(985): Xaa can be any naturally occurring amino acid
  misc_feature (988)..(989): Xaa can be any naturally occurring amino acid
  misc_feature (991)..(999): Xaa can be any naturally occurring amino acid
  misc_feature (1001)..(1019): Xaa can be any naturally occurring amino acid
  misc_feature (1024)..(1029): Xaa can be any naturally occurring amino acid
  misc_feature (1031)..(1031): Xaa can be any naturally occurring amino acid
  misc_feature (1035)..(1035): Xaa can be any naturally occurring amino acid
  misc_feature (1037)..(1075): Xaa can be any naturally occurring amino acid
  misc_feature (1077)..(1077): Xaa can be any naturally occurring amino acid
  misc_feature (1079)..(1164): Xaa can be any naturally occurring amino acid
  misc_feature (1166)..(1170): Xaa can be any naturally occurring amino acid
  misc_feature (1173)..(1174): Xaa can be any naturally occurring amino acid
  misc_feature (1176)..(1195): Xaa can be any naturally occurring amino acid
  misc_feature (1197)..(1222): Xaa can be any naturally occurring amino acid
  misc_feature (1224)..(1681): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDXXXXXXXXXXXXXXXXXXXXXPVXXXXXGGXWXXGXXXXXXXXXXXXXXXXXXXXXXXXXXXXXAXXGXXXXXXXYRXXPXXXXXXXXXDXXXXXXXXXXXXXXXXXXXGGDPXXXXXXGXSAGXHXXXXXXXXXXXXXXXXXXXXXXXXXXXXXXXXXXXXXXXGXYXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXHGXXDXXXXXXXXXXXXXXXXXXXXLXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67872 - protein, 220 aa, artificial
  consensus sequence
  misc_feature (1)..(1): Xaa can be any naturally occurring amino acid
  misc_feature (3)..(22): Xaa can be any naturally occurring amino acid
  misc_feature (24)..(32): Xaa can be any naturally occurring amino acid
  misc_feature (34)..(47): Xaa can be any naturally occurring amino acid
  misc_feature (49)..(50): Xaa can be any naturally occurring amino acid
  misc_feature (52)..(53): Xaa can be any naturally occurring amino acid
  misc_feature (58)..(58): Xaa can be any naturally occurring amino acid
  misc_feature (64)..(64): Xaa can be any naturally occurring amino acid
  misc_feature (73)..(73): Xaa can be any naturally occurring amino acid
  misc_feature (79)..(79): Xaa can be any naturally occurring amino acid
  misc_feature (81)..(81): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (90)..(90): Xaa can be any naturally occurring amino acid
  misc_feature (94)..(94): Xaa can be any naturally occurring amino acid
  misc_feature (98)..(98): Xaa can be any naturally occurring amino acid
  misc_feature (101)..(101): Xaa can be any naturally occurring amino acid
  misc_feature (113)..(113): Xaa can be any naturally occurring amino acid
  misc_feature (121)..(123): Xaa can be any naturally occurring amino acid
  misc_feature (127)..(127): Xaa can be any naturally occurring amino acid
  misc_feature (135)..(135): Xaa can be any naturally occurring amino acid
  misc_feature (137)..(137): Xaa can be any naturally occurring amino acid
  misc_feature (146)..(146): Xaa can be any naturally occurring amino acid
  misc_feature (148)..(148): Xaa can be any naturally occurring amino acid
  misc_feature (150)..(150): Xaa can be any naturally occurring amino acid
  misc_feature (155)..(155): Xaa can be any naturally occurring amino acid
  misc_feature (157)..(157): Xaa can be any naturally occurring amino acid
  misc_feature (161)..(161): Xaa can be any naturally occurring amino acid
  misc_feature (164)..(164): Xaa can be any naturally occurring amino acid
  misc_feature (177)..(177): Xaa can be any naturally occurring amino acid
  misc_feature (179)..(179): Xaa can be any naturally occurring amino acid
  misc_feature (181)..(184): Xaa can be any naturally occurring amino acid
  misc_feature (186)..(220): Xaa can be any naturally occurring amino acid
XMXXXXXXXXXXXXXXXXXXXXAXXXXXXXXXAXXXXXXXXXXXXXXSXXEXXCVYTXYVRTGXIWKGGTDSXIGVTLXGXDGXGXRXIXDLEXWGGXMGXGHDYYERGNLDXFSGRGPCXXXAPCXMNLTSDGXGXHHGWYCNYXEXTXTGPHXGXCAQXLFXVEQWLATDASPYXLXAXXXXCXXXXXXXXXXXXXXXXXXXXXXXXXXXXXXXXXXX

SEQ ID NO: 67873 - protein, 452 aa, artificial
  consensus sequence
  misc_feature (1)..(30): Xaa can be any naturally occurring amino acid
  misc_feature (32)..(32): Xaa can be any naturally occurring amino acid
  misc_feature (36)..(68): Xaa can be any naturally occurring amino acid
  misc_feature (73)..(73): Xaa can be any naturally occurring amino acid
  misc_feature (76)..(78): Xaa can be any naturally occurring amino acid
  misc_feature (81)..(81): Xaa can be any naturally occurring amino acid
  misc_feature (84)..(84): Xaa can be any naturally occurring amino acid
  misc_feature (87)..(116): Xaa can be any naturally occurring amino acid
  misc_feature (119)..(119): Xaa can be any naturally occurring amino acid
  misc_feature (121)..(129): Xaa can be any naturally occurring amino acid
  misc_feature (132)..(132): Xaa can be any naturally occurring amino acid
  misc_feature (134)..(136): Xaa can be any naturally occurring amino acid
  misc_feature (139)..(139): Xaa can be any naturally occurring amino acid
  misc_feature (141)..(143): Xaa can be any naturally occurring amino acid
  misc_feature (145)..(147): Xaa can be any naturally occurring amino acid
  misc_feature (149)..(149): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
  misc_feature (158)..(158): Xaa can be any naturally occurring amino acid
  misc_feature (160)..(161): Xaa can be any naturally occurring amino acid
  misc_feature (166)..(167): Xaa can be any naturally occurring amino acid
  misc_feature (169)..(169): Xaa can be any naturally occurring amino acid
  misc_feature (171)..(172): Xaa can be any naturally occurring amino acid
  misc_feature (174)..(176): Xaa can be any naturally occurring amino acid
  misc_feature (179)..(181): Xaa can be any naturally occurring amino acid
  misc_feature (183)..(183): Xaa can be any naturally occurring amino acid
  misc_feature (185)..(185): Xaa can be any naturally occurring amino acid
  misc_feature (190)..(192): Xaa can be any naturally occurring amino acid
  misc_feature (198)..(198): Xaa can be any naturally occurring amino acid
  misc_feature (202)..(202): Xaa can be any naturally occurring amino acid
  misc_feature (205)..(205): Xaa can be any naturally occurring amino acid
  misc_feature (212)..(212): Xaa can be any naturally occurring amino acid
  misc_feature (216)..(216): Xaa can be any naturally occurring amino acid
  misc_feature (221)..(221): Xaa can be any naturally occurring amino acid
  misc_feature (224)..(225): Xaa can be any naturally occurring amino acid
  misc_feature (229)..(229): Xaa can be any naturally occurring amino acid
  misc_feature (232)..(232): Xaa can be any naturally occurring amino acid
  misc_feature (234)..(234): Xaa can be any naturally occurring amino acid
  misc_feature (236)..(238): Xaa can be any naturally occurring amino acid
  misc_feature (241)..(241): Xaa can be any naturally occurring amino acid
  misc_feature (243)..(244): Xaa can be any naturally occurring amino acid
  misc_feature (247)..(248): Xaa can be any naturally occurring amino acid
  misc_feature (251)..(251): Xaa can be any naturally occurring amino acid
  misc_feature (254)..(254): Xaa can be any naturally occurring amino acid
  misc_feature (259)..(259): Xaa can be any naturally occurring amino acid
  misc_feature (261)..(269): Xaa can be any naturally occurring amino acid
  misc_feature (271)..(273): Xaa can be any naturally occurring amino acid
  misc_feature (275)..(277): Xaa can be any naturally occurring amino acid
  misc_feature (279)..(287): Xaa can be any naturally occurring amino acid
  misc_feature (289)..(289): Xaa can be any naturally occurring amino acid
  misc_feature (292)..(292): Xaa can be any naturally occurring amino acid
  misc_feature (294)..(452): Xaa can be any naturally occurring amino acid
XXXXXXXXXXXXXXXXXXXXXXXXXXXXXXEXLLEXXXXXXXXXXXXXXXXXXXXXXXXXXXXXXXXXGRDKXGRXXXRIXGKXFPXXXXXXXXXXXXXXXXXXXXXXXXXXXXXXARXLXXXXXXXXXLKXYXXXRVXPXXXGXXXFXVXYXHXXVXRXXNFPGXXAXRXXYXXXPAXXXEXLXAVYFXXXHPGLQXRLFXATXGRFLFSXGLYXKLRYXSRXXYLWXHVXKXEXXXPEXVXXHDXXLEXRPXMDYGXEXXXXXXXXXAXXXDXXXSXXXXXXXXXSXRCXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67874 - protein, 717 aa, artificial
  consensus sequence
  misc_feature (1)..(8): Xaa can be any naturally occurring amino acid
  misc_feature (10)..(10): Xaa can be any naturally occurring amino acid
  misc_feature (13)..(13): Xaa can be any naturally occurring amino acid
  misc_feature (15)..(16): Xaa can be any naturally occurring amino acid
  misc_feature (18)..(18): Xaa can be any naturally occurring amino acid
  misc_feature (24)..(24): Xaa can be any naturally occurring amino acid
  misc_feature (28)..(28): Xaa can be any naturally occurring amino acid
  misc_feature (34)..(34): Xaa can be any naturally occurring amino acid
  misc_feature (67)..(69): Xaa can be any naturally occurring amino acid
  misc_feature (71)..(73): Xaa can be any naturally occurring amino acid
  misc_feature (75)..(77): Xaa can be any naturally occurring amino acid
  misc_feature (79)..(80): Xaa can be any naturally occurring amino acid
  misc_feature (82)..(103): Xaa can be any naturally occurring amino acid
  misc_feature (107)..(107): Xaa can be any naturally occurring amino acid
  misc_feature (116)..(116): Xaa can be any naturally occurring amino acid
  misc_feature (120)..(122): Xaa can be any naturally occurring amino acid
  misc_feature (125)..(125): Xaa can be any naturally occurring amino acid
  misc_feature (132)..(132): Xaa can be any naturally occurring amino acid
  misc_feature (135)..(136): Xaa can be any naturally occurring amino acid
  misc_feature (146)..(149): Xaa can be any naturally occurring amino acid
  misc_feature (152)..(152): Xaa can be any naturally occurring amino acid
  misc_feature (154)..(156): Xaa can be any naturally occurring amino acid
  misc_feature (163)..(163): Xaa can be any naturally occurring amino acid
  misc_feature (178)..(178): Xaa can be any naturally occurring amino acid
  misc_feature (181)..(181): Xaa can be any naturally occurring amino acid
  misc_feature (186)..(187): Xaa can be any naturally occurring amino acid
  misc_feature (192)..(194): Xaa can be any naturally occurring amino acid
  misc_feature (198)..(199): Xaa can be any naturally occurring amino acid
  misc_feature (202)..(203): Xaa can be any naturally occurring amino acid
  misc_feature (205)..(212): Xaa can be any naturally occurring amino acid
  misc_feature (214)..(215): Xaa can be any naturally occurring amino acid
  misc_feature (217)..(222): Xaa can be any naturally occurring amino acid
  misc_feature (224)..(229): Xaa can be any naturally occurring amino acid
  misc_feature (233)..(233): Xaa can be any naturally occurring amino acid
  misc_feature (235)..(238): Xaa can be any naturally occurring amino acid
  misc_feature (240)..(241): Xaa can be any naturally occurring amino acid
  misc_feature (245)..(245): Xaa can be any naturally occurring amino acid
  misc_feature (247)..(248): Xaa can be any naturally occurring amino acid
  misc_feature (274)..(274): Xaa can be any naturally occurring amino acid
  misc_feature (277)..(277): Xaa can be any naturally occurring amino acid
  misc_feature (281)..(281): Xaa can be any naturally occurring amino acid
  misc_feature (285)..(285): Xaa can be any naturally occurring amino acid
  misc_feature (288)..(289): Xaa can be any naturally occurring amino acid
  misc_feature (291)..(291): Xaa can be any naturally occurring amino acid
  misc_feature (300)..(301): Xaa can be any naturally occurring amino acid
  misc_feature (310)..(310): Xaa can be any naturally occurring amino acid
  misc_feature (312)..(312): Xaa can be any naturally occurring amino acid
  misc_feature (317)..(319): Xaa can be any naturally occurring amino acid
  misc_feature (322)..(322): Xaa can be any naturally occurring amino acid
  misc_feature (325)..(326): Xaa can be any naturally occurring amino acid
  misc_feature (329)..(329): Xaa can be any naturally occurring amino acid
  misc_feature (334)..(334): Xaa can be any naturally occurring amino acid
  misc_feature (345)..(346): Xaa can be any naturally occurring amino acid
  misc_feature (354)..(354): Xaa can be any naturally occurring amino acid
  misc_feature (356)..(356): Xaa can be any naturally occurring amino acid
  misc_feature (359)..(359): Xaa can be any naturally occurring amino acid
  misc_feature (361)..(361): Xaa can be any naturally occurring amino acid
  misc_feature (375)..(717): Xaa can be any naturally occurring amino acid
XXXXXXXXKXEEXLXXIXILKRAXKLLXGNINLXLFLFLCSLPLFCFLIFFELSLQTTVSLASQYLXXXLXXXDXXXVXXDXXXXXXXXXXXXXXXXXXXXXXLIPXLIQTFLLYXFPYXXXDLXTTTTIVXASXXVHTSEEEPLXXXXLVXRXXXICQNRLXGCLITSLYVLLLSTXVFXGFLFXXTNYFXXXSLTXXGEXXYXXXXXXXXDXXGXXXXXXVXXXXXXLFDXVXXXXAXXHGAXFXXLLAMFSKWSAGWNMGLVVSVLEEEEXGQXIYGXDALXLSXXYXKGHEKRGLXXMLVFLVFAXAXRMPCXXXKCXESXXGNXVLYTXFYVGLICVGNXXKWVACVVXYXDCXTXVLEKKGDVEIGSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67875 - protein, 554 aa, artificial
  consensus sequence
  misc_feature (1)..(11): Xaa can be any naturally occurring amino acid
  misc_feature (14)..(16): Xaa can be any naturally occurring amino acid
  misc_feature (23)..(23): Xaa can be any naturally occurring amino acid
  misc_feature (28)..(29): Xaa can be any naturally occurring amino acid
  misc_feature (31)..(31): Xaa can be any naturally occurring amino acid
  misc_feature (33)..(33): Xaa can be any naturally occurring amino acid
  misc_feature (35)..(48): Xaa can be any naturally occurring amino acid
  misc_feature (50)..(50): Xaa can be any naturally occurring amino acid
  misc_feature (53)..(54): Xaa can be any naturally occurring amino acid
  misc_feature (57)..(57): Xaa can be any naturally occurring amino acid
  misc_feature (59)..(67): Xaa can be any naturally occurring amino acid
  misc_feature (70)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (79)..(80): Xaa can be any naturally occurring amino acid
  misc_feature (82)..(82): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(91): Xaa can be any naturally occurring amino acid
  misc_feature (93)..(100): Xaa can be any naturally occurring amino acid
  misc_feature (103)..(103): Xaa can be any naturally occurring amino acid
  misc_feature (107)..(107): Xaa can be any naturally occurring amino acid
  misc_feature (110)..(110): Xaa can be any naturally occurring amino acid
  misc_feature (113)..(113): Xaa can be any naturally occurring amino acid
  misc_feature (115)..(119): Xaa can be any naturally occurring amino acid
  misc_feature (121)..(122): Xaa can be any naturally occurring amino acid
  misc_feature (127)..(152): Xaa can be any naturally occurring amino acid
  misc_feature (155)..(155): Xaa can be any naturally occurring amino acid
  misc_feature (161)..(162): Xaa can be any naturally occurring amino acid
  misc_feature (165)..(166): Xaa can be any naturally occurring amino acid
  misc_feature (168)..(169): Xaa can be any naturally occurring amino acid
  misc_feature (171)..(171): Xaa can be any naturally occurring amino acid
  misc_feature (174)..(175): Xaa can be any naturally occurring amino acid
  misc_feature (177)..(250): Xaa can be any naturally occurring amino acid
  misc_feature (253)..(253): Xaa can be any naturally occurring amino acid
  misc_feature (255)..(323): Xaa can be any naturally occurring amino acid
  misc_feature (325)..(335): Xaa can be any naturally occurring amino acid
  misc_feature (337)..(554): Xaa can be any naturally occurring amino acid
XXXXXXXXXXXAGXXXQKQLLSXIRDFXXEXSXGXXXXXXXXXXXXXXEXRVXXLKXRXXXXXXXXXAAXXEXEXAKRXXEXAEXELXGXXVXXXXXXXXIQXLEAXISXLQXEXXXXXSXXDALKXXXXXXXXXXXXXXXXXXXXXXXXXXRDXFISQMXXLNXXIXXRXFQXXVXXXXXXXXXXXXXXXXXXXXXXXXXXXXXXXXXXXXXXXXXXXXXXXXXXXXXXXXXXXXXXXXXXXXXXXXXXEEXYXXXXXXXXXXXXXXXXXXXXXXXXXXXXXXXXXXXXXXXXXXXXXXXXXXXXXXXXXXXXXXXXXXXXXEXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67876 - protein, 3126 aa, artificial
  consensus sequence
  misc_feature (1)..(1291): Xaa can be any naturally occurring amino acid
  misc_feature (1294)..(1298): Xaa can be any naturally occurring amino acid
  misc_feature (1300)..(1300): Xaa can be any naturally occurring amino acid
  misc_feature (1302)..(1302): Xaa can be any naturally occurring amino acid
  misc_feature (1305)..(1306): Xaa can be any naturally occurring amino acid
  misc_feature (1308)..(1308): Xaa can be any naturally occurring amino acid
  misc_feature (1310)..(1312): Xaa can be any naturally occurring amino acid
  misc_feature (1314)..(1320): Xaa can be any naturally occurring amino acid
  misc_feature (1323)..(1342): Xaa can be any naturally occurring amino acid
  misc_feature (1344)..(1351): Xaa can be any naturally occurring amino acid
  misc_feature (1353)..(1362): Xaa can be any naturally occurring amino acid
  misc_feature (1364)..(1375): Xaa can be any naturally occurring amino acid
  misc_feature (1378)..(1409): Xaa can be any naturally occurring amino acid
  misc_feature (1411)..(1415): Xaa can be any naturally occurring amino acid
  misc_feature (1417)..(1418): Xaa can be any naturally occurring amino acid
  misc_feature (1420)..(1423): Xaa can be any naturally occurring amino acid
  misc_feature (1426)..(3126): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDXXXXXLXSXWLXXSXDXXXGXXXXXXXYWXXXXXXXXXXXXXXXXXXXXRXXXXXXXXWXXXXXXXXXXFXXXXXXXXXXXXSGXXXXXXXXXXXXXXXXXXXXXXXXXXXXXXXXFXXXXXWXXLXXXXKWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67877 - protein, 308 aa, artificial
  consensus sequence
  misc_feature (1)..(32): Xaa can be any naturally occurring amino acid
  misc_feature (34)..(55): Xaa can be any naturally occurring amino acid
  misc_feature (57)..(59): Xaa can be any naturally occurring amino acid
  misc_feature (61)..(63): Xaa can be any naturally occurring amino acid
  misc_feature (65)..(104): Xaa can be any naturally occurring amino acid
  misc_feature (106)..(106): Xaa can be any naturally occurring amino acid
  misc_feature (108)..(126): Xaa can be any naturally occurring amino acid
  misc_feature (128)..(128): Xaa can be any naturally occurring amino acid
  misc_feature (132)..(137): Xaa can be any naturally occurring amino acid
  misc_feature (139)..(140): Xaa can be any naturally occurring amino acid
  misc_feature (142)..(152): Xaa can be any naturally occurring amino acid
  misc_feature (155)..(172): Xaa can be any naturally occurring amino acid
  misc_feature (174)..(174): Xaa can be any naturally occurring amino acid
  misc_feature (176)..(176): Xaa can be any naturally occurring amino acid
  misc_feature (180)..(181): Xaa can be any naturally occurring amino acid
  misc_feature (184)..(184): Xaa can be any naturally occurring amino acid
  misc_feature (188)..(188): Xaa can be any naturally occurring amino acid
  misc_feature (190)..(190): Xaa can be any naturally occurring amino acid
  misc_feature (206)..(208): Xaa can be any naturally occurring amino acid
  misc_feature (210)..(213): Xaa can be any naturally occurring amino acid
  misc_feature (216)..(216): Xaa can be any naturally occurring amino acid
  misc_feature (218)..(220): Xaa can be any naturally occurring amino acid
  misc_feature (222)..(225): Xaa can be any naturally occurring amino acid
  misc_feature (227)..(229): Xaa can be any naturally occurring amino acid
  misc_feature (231)..(231): Xaa can be any naturally occurring amino acid
  misc_feature (234)..(235): Xaa can be any naturally occurring amino acid
  misc_feature (239)..(240): Xaa can be any naturally occurring amino acid
  misc_feature (242)..(242): Xaa can be any naturally occurring amino acid
  misc_feature (245)..(252): Xaa can be any naturally occurring amino acid
  misc_feature (254)..(255): Xaa can be any naturally occurring amino acid
  misc_feature (257)..(258): Xaa can be any naturally occurring amino acid
  misc_feature (261)..(308): Xaa can be any naturally occurring amino acid
XXXXXXXXXXXXXXXXXXXXXXXXXXXXXXXXSXXXXXXXXXXXXXXXXXXXXXXYXXXPXXXSXXXXXXXXXXXXXXXXXXXXXXXXXXXXXXXXXXXXXXXXSXKXXXXXXXXXXXXXXXXXXXFXQKRXXXXXXSXXSXXXXXXXXXXXTPXXXXXXXXXXXXXXXXXXEXDXEYYXXHKXSPLXEXEFADTRKPITRATDGXXXAXXXXDVXGXXXEXXXXAXXXLXRAXXMFRXXAXRGXXXXXXXXRXXRXXRGXXXXXXXXXXXXXXXXXXXXXXXXXXXXXXXXXXXXXXXXXXXXXXXX

SEQ ID NO: 67878 - protein, 1928 aa, artificial
  consensus sequence
  misc_feature (1)..(1736): Xaa can be any naturally occurring amino acid
  misc_feature (1738)..(1739): Xaa can be any naturally occurring amino acid
  misc_feature (1741)..(1747): Xaa can be any naturally occurring amino acid
  misc_feature (1749)..(1749): Xaa can be any naturally occurring amino acid
  misc_feature (1752)..(1766): Xaa can be any naturally occurring amino acid
  misc_feature (1770)..(1770): Xaa can be any naturally occurring amino acid
  misc_feature (1772)..(1774): Xaa can be any naturally occurring amino acid
  misc_feature (1776)..(1776): Xaa can be any naturally occurring amino acid
  misc_feature (1778)..(1779): Xaa can be any naturally occurring amino acid
  misc_feature (1781)..(1785): Xaa can be any naturally occurring amino acid
  misc_feature (1787)..(1792): Xaa can be any naturally occurring amino acid
  misc_feature (1798)..(1800): Xaa can be any naturally occurring amino acid
  misc_feature (1803)..(1804): Xaa can be any naturally occurring amino acid
  misc_feature (1806)..(1808): Xaa can be any naturally occurring amino acid
  misc_feature (1810)..(1817): Xaa can be any naturally occurring amino acid
  misc_feature (1820)..(1821): Xaa can be any naturally occurring amino acid
  misc_feature (1824)..(1838): Xaa can be any naturally occurring amino acid
  misc_feature (1841)..(1856): Xaa can be any naturally occurring amino acid
  misc_feature (1858)..(1859): Xaa can be any naturally occurring amino acid
  misc_feature (1862)..(1862): Xaa can be any naturally occurring amino acid
  misc_feature (1864)..(1865): Xaa can be any naturally occurring amino acid
  misc_feature (1868)..(1868): Xaa can be any naturally occurring amino acid
  misc_feature (1872)..(1890): Xaa can be any naturally occurring amino acid
  misc_feature (1892)..(1900): Xaa can be any naturally occurring amino acid
  misc_feature (1902)..(1903): Xaa can be any naturally occurring amino acid
  misc_feature (1905)..(1908): Xaa can be any naturally occurring amino acid
  misc_feature (1910)..(1928): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXPXXXXXXXNXDGXXXXXXXXXXXXXXXGGLXRXXXGXWXXGXXXXXGXXXXXXAELWGXXXGLXXAXXXGXXXXXXXXDSXXVVXXXXXXXXXXXXXXXLVXXXXXXXXXXXXXXXXHXXREXNXXADXLANXXXXXXXXXXXXXXXXXXXPXXXXXXXXXDXXGXXXXRXXXXXXXXXXXXXXXXXXX

SEQ ID NO: 67879 - protein, 202 aa, artificial
  consensus sequence
  misc_feature (2)..(4): Xaa can be any naturally occurring amino acid
  misc_feature (6)..(14): Xaa can be any naturally occurring amino acid
  misc_feature (20)..(20): Xaa can be any naturally occurring amino acid
  misc_feature (28)..(28): Xaa can be any naturally occurring amino acid
  misc_feature (30)..(30): Xaa can be any naturally occurring amino acid
  misc_feature (35)..(36): Xaa can be any naturally occurring amino acid
  misc_feature (39)..(43): Xaa can be any naturally occurring amino acid
  misc_feature (45)..(48): Xaa can be any naturally occurring amino acid
  misc_feature (50)..(63): Xaa can be any naturally occurring amino acid
  misc_feature (70)..(70): Xaa can be any naturally occurring amino acid
  misc_feature (73)..(73): Xaa can be any naturally occurring amino acid
  misc_feature (76)..(76): Xaa can be any naturally occurring amino acid
  misc_feature (78)..(78): Xaa can be any naturally occurring amino acid
  misc_feature (84)..(84): Xaa can be any naturally occurring amino acid
  misc_feature (87)..(111): Xaa can be any naturally occurring amino acid
  misc_feature (114)..(114): Xaa can be any naturally occurring amino acid
  misc_feature (116)..(118): Xaa can be any naturally occurring amino acid
  misc_feature (122)..(122): Xaa can be any naturally occurring amino acid
  misc_feature (129)..(129): Xaa can be any naturally occurring amino acid
  misc_feature (132)..(133): Xaa can be any naturally occurring amino acid
  misc_feature (136)..(136): Xaa can be any naturally occurring amino acid
  misc_feature (140)..(140): Xaa can be any naturally occurring amino acid
  misc_feature (146)..(146): Xaa can be any naturally occurring amino acid
  misc_feature (148)..(148): Xaa can be any naturally occurring amino acid
  misc_feature (150)..(150): Xaa can be any naturally occurring amino acid
  misc_feature (153)..(153): Xaa can be any naturally occurring amino acid
  misc_feature (155)..(157): Xaa can be any naturally occurring amino acid
  misc_feature (167)..(202): Xaa can be any naturally occurring amino acid
MXXXAXXXXXXXXXRKPVFXKVDQLKPXTXGHTLXXKVXXXXXVXXXXRXXXXXXXXXXXXXXRIAECLXGDXTGXIXFTARNXQVXXXXXXXXXXXXXXXXXXXXXXXXXDLXKXXXTVIXRNAKIDXFKXXMRXAVDXWGRIEXTXPXSFXVXXXNNLSLVEYEXXXXXXXXXXXXXXXXXXXXXXXXXXXXXXXXXXXX

SEQ ID NO: 67880 - protein, 882 aa, artificial
  consensus sequence
  misc_feature (1)..(457): Xaa can be any naturally occurring amino acid
  misc_feature (459)..(540): Xaa can be any naturally occurring amino acid
  misc_feature (542)..(542): Xaa can be any naturally occurring amino acid
  misc_feature (545)..(547): Xaa can be any naturally occurring amino acid
  misc_feature (549)..(549): Xaa can be any naturally occurring amino acid
  misc_feature (551)..(552): Xaa can be any naturally occurring amino acid
  misc_feature (555)..(560): Xaa can be any naturally occurring amino acid
  misc_feature (562)..(564): Xaa can be any naturally occurring amino acid
  misc_feature (566)..(592): Xaa can be any naturally occurring amino acid
  misc_feature (594)..(595): Xaa can be any naturally occurring amino acid
  misc_feature (599)..(600): Xaa can be any naturally occurring amino acid
  misc_feature (602)..(603): Xaa can be any naturally occurring amino acid
  misc_feature (606)..(607): Xaa can be any naturally occurring amino acid
  misc_feature (612)..(615): Xaa can be any naturally occurring amino acid
  misc_feature (617)..(618): Xaa can be any naturally occurring amino acid
  misc_feature (620)..(622): Xaa can be any naturally occurring amino acid
  misc_feature (624)..(628): Xaa can be any naturally occurring amino acid
  misc_feature (631)..(632): Xaa can be any naturally occurring amino acid
  misc_feature (634)..(635): Xaa can be any naturally occurring amino acid
  misc_feature (638)..(692): Xaa can be any naturally occurring amino acid
  misc_feature (694)..(696): Xaa can be any naturally occurring amino acid
  misc_feature (698)..(703): Xaa can be any naturally occurring amino acid
  misc_feature (705)..(710): Xaa can be any naturally occurring amino acid
  misc_feature (712)..(721): Xaa can be any naturally occurring amino acid
  misc_feature (723)..(724): Xaa can be any naturally occurring amino acid
  misc_feature (727)..(728): Xaa can be any naturally occurring amino acid
  misc_feature (730)..(733): Xaa can be any naturally occurring amino acid
  misc_feature (736)..(738): Xaa can be any naturally occurring amino acid
  misc_feature (740)..(741): Xaa can be any naturally occurring amino acid
  misc_feature (743)..(744): Xaa can be any naturally occurring amino acid
  misc_feature (747)..(750): Xaa can be any naturally occurring amino acid
  misc_feature (752)..(754): Xaa can be any naturally occurring amino acid
  misc_feature (756)..(762): Xaa can be any naturally occurring amino acid
  misc_feature (764)..(882): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXLXSTXXXRXWXXAGXXXXXXSXXXSXXXXXXXXXXXXXXXXXXXXXXXXXXXYXXADLXXGXXHWXXDNYGXXXXPXXGXXXIXXXXXHHXXPXXITXXXXXXXXXXXXXXXXXXXXXXXXXXXXXXXXXXXXXXXXXXXXXXXXXXXXXXXHXXXHXXXXXXPXXXXXXQXXXXXXXXXXHXXHHXXPXXXXYCXXXGXXNXXLDXXXXFXXXEXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67881 - protein, 377 aa, artificial
  consensus sequence
  misc_feature (1)..(2): Xaa can be any naturally occurring amino acid
  misc_feature (4)..(4): Xaa can be any naturally occurring amino acid
  misc_feature (6)..(16): Xaa can be any naturally occurring amino acid
  misc_feature (18)..(25): Xaa can be any naturally occurring amino acid
  misc_feature (28)..(38): Xaa can be any naturally occurring amino acid
  misc_feature (40)..(44): Xaa can be any naturally occurring amino acid
  misc_feature (46)..(51): Xaa can be any naturally occurring amino acid
  misc_feature (53)..(55): Xaa can be any naturally occurring amino acid
  misc_feature (57)..(64): Xaa can be any naturally occurring amino acid
  misc_feature (66)..(78): Xaa can be any naturally occurring amino acid
  misc_feature (81)..(88): Xaa can be any naturally occurring amino acid
  misc_feature (91)..(92): Xaa can be any naturally occurring amino acid
  misc_feature (94)..(96): Xaa can be any naturally occurring amino acid
  misc_feature (98)..(99): Xaa can be any naturally occurring amino acid
  misc_feature (102)..(102): Xaa can be any naturally occurring amino acid
  misc_feature (105)..(107): Xaa can be any naturally occurring amino acid
  misc_feature (109)..(109): Xaa can be any naturally occurring amino acid
  misc_feature (111)..(111): Xaa can be any naturally occurring amino acid
  misc_feature (119)..(119): Xaa can be any naturally occurring amino acid
  misc_feature (122)..(122): Xaa can be any naturally occurring amino acid
  misc_feature (130)..(130): Xaa can be any naturally occurring amino acid
  misc_feature (133)..(133): Xaa can be any naturally occurring amino acid
  misc_feature (135)..(143): Xaa can be any naturally occurring amino acid
  misc_feature (147)..(148): Xaa can be any naturally occurring amino acid
  misc_feature (150)..(152): Xaa can be any naturally occurring amino acid
  misc_feature (154)..(159): Xaa can be any naturally occurring amino acid
  misc_feature (161)..(161): Xaa can be any naturally occurring amino acid
  misc_feature (163)..(164): Xaa can be any naturally occurring amino acid
  misc_feature (166)..(166): Xaa can be any naturally occurring amino acid
  misc_feature (168)..(174): Xaa can be any naturally occurring amino acid
  misc_feature (176)..(183): Xaa can be any naturally occurring amino acid
  misc_feature (185)..(213): Xaa can be any naturally occurring amino acid
  misc_feature (215)..(219): Xaa can be any naturally occurring amino acid
  misc_feature (222)..(223): Xaa can be any naturally occurring amino acid
  misc_feature (225)..(232): Xaa can be any naturally occurring amino acid
  misc_feature (234)..(235): Xaa can be any naturally occurring amino acid
  misc_feature (238)..(239): Xaa can be any naturally occurring amino acid
  misc_feature (242)..(242): Xaa can be any naturally occurring amino acid
  misc_feature (244)..(254): Xaa can be any naturally occurring amino acid
  misc_feature (257)..(257): Xaa can be any naturally occurring amino acid
  misc_feature (259)..(259): Xaa can be any naturally occurring amino acid
  misc_feature (266)..(271): Xaa can be any naturally occurring amino acid
  misc_feature (273)..(377): Xaa can be any naturally occurring amino acid
XXMXTXXXXXXXXXXXSXXXXXXXXFQXXXXXXXXXXXPXXXXXSXXXXXXMXXXNXXXXXXXXTXXXXXXXXXXXXXLKXXXXXXXXWSXXEXXXLXXGLXKYXXXPXIXKYIKIAAXLPXKTVRDVAXRCXWXXXXXXXXXRRKXXEXXXGXXXXXXKXKXXEXSXXXXXXXVXXXXXXXXSXXXXXXXXXXXXXXXXXXXXXXXXXXXXXNXXXXXQIXXNXXXXXXXXNXXLFXXARXNXXXXXXXXXXXPGXMXKMPPLPXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67882 - protein, 283 aa, artificial
  consensus sequence
  misc_feature (1)..(10): Xaa can be any naturally occurring amino acid
  misc_feature (12)..(12): Xaa can be any naturally occurring amino acid
  misc_feature (14)..(53): Xaa can be any naturally occurring amino acid
  misc_feature (55)..(56): Xaa can be any naturally occurring amino acid
  misc_feature (58)..(73): Xaa can be any naturally occurring amino acid
  misc_feature (75)..(91): Xaa can be any naturally occurring amino acid
  misc_feature (93)..(93): Xaa can be any naturally occurring amino acid
  misc_feature (95)..(207): Xaa can be any naturally occurring amino acid
  misc_feature (209)..(228): Xaa can be any naturally occurring amino acid
  misc_feature (230)..(232): Xaa can be any naturally occurring amino acid
  misc_feature (235)..(236): Xaa can be any naturally occurring amino acid
  misc_feature (243)..(243): Xaa can be any naturally occurring amino acid
  misc_feature (245)..(249): Xaa can be any naturally occurring amino acid
  misc_feature (256)..(256): Xaa can be any naturally occurring amino acid
  misc_feature (258)..(277): Xaa can be any naturally occurring amino acid
  misc_feature (279)..(283): Xaa can be any naturally occurring amino acid
XXXXXXXXXXMXSXXXXXXXXXXXXXXXXXXXXXXXXXXXXXXXXXXXXXXXXKXXKXXXXXXXXXXXXXXXXFXXXXXXXXXXXXXXXXXLXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXMXXXVCXXCHMLVMXCXXXXXCPNCKFXHXXXXXXXXXXXXXXXXXXXXLXXXXX

SEQ ID NO: 67883 - protein, 393 aa, artificial
  consensus sequence
  misc_feature (1)..(61): Xaa can be any naturally occurring amino acid
  misc_feature (65)..(65): Xaa can be any naturally occurring amino acid
  misc_feature (67)..(67): Xaa can be any naturally occurring amino acid
  misc_feature (69)..(70): Xaa can be any naturally occurring amino acid
  misc_feature (73)..(77): Xaa can be any naturally occurring amino acid
  misc_feature (79)..(86): Xaa can be any naturally occurring amino acid
  misc_feature (88)..(89): Xaa can be any naturally occurring amino acid
  misc_feature (91)..(117): Xaa can be any naturally occurring amino acid
  misc_feature (119)..(126): Xaa can be any naturally occurring amino acid
  misc_feature (128)..(128): Xaa can be any naturally occurring amino acid
  misc_feature (133)..(135): Xaa can be any naturally occurring amino acid
  misc_feature (138)..(138): Xaa can be any naturally occurring amino acid
  misc_feature (145)..(145): Xaa can be any naturally occurring amino acid
  misc_feature (147)..(148): Xaa can be any naturally occurring amino acid
  misc_feature (151)..(152): Xaa can be any naturally occurring amino acid
  misc_feature (158)..(159): Xaa can be any naturally occurring amino acid
  misc_feature (161)..(161): Xaa can be any naturally occurring amino acid
  misc_feature (163)..(165): Xaa can be any naturally occurring amino acid
  misc_feature (169)..(180): Xaa can be any naturally occurring amino acid
  misc_feature (182)..(209): Xaa can be any naturally occurring amino acid
  misc_feature (212)..(212): Xaa can be any naturally occurring amino acid
  misc_feature (214)..(214): Xaa can be any naturally occurring amino acid
  misc_feature (216)..(217): Xaa can be any naturally occurring amino acid
  misc_feature (220)..(259): Xaa can be any naturally occurring amino acid
  misc_feature (261)..(289): Xaa can be any naturally occurring amino acid
  misc_feature (291)..(292): Xaa can be any naturally occurring amino acid
  misc_feature (294)..(316): Xaa can be any naturally occurring amino acid
  misc_feature (318)..(318): Xaa can be any naturally occurring amino acid
  misc_feature (320)..(393): Xaa can be any naturally occurring amino acid
XXXXXXXXXXXXXXXXXXXXXXXXXXXXXXXXXXXXXXXXXXXXXXXXXXXXXXXXXXXXXAPNXEXIXXSLXXXXXNXXXXXXXXRXXGXXXXXXXXXXXXXXXXXXXXXXXXXXXEXXXXXXXXTXELNSXXXLPXHWEQCLXDXXTGXXYYINWXXGXRXXXDPRXXXXXXXXXXXXSXXXXXXXXXXXXXXXXXXXXXXXXXXXXSSXYXSXXSSXXXXXXXXXXXXXXXXXXXXXXXXXXXXXXXXXXXXXXXXDXXXXXXXXXXXXXXXXXXXXXXXXXXXXXLXXFXXXXXXXXXXXXXXXXXXXXXXXSXSXXXXXXXXXXXXXXXXXXXXXXXXXXXXXXXXXXXXXXXXXXXXXXXXXXXXXXXXXXXXXXXXXXXXXXXXXX

SEQ ID NO: 67884 - protein, 377 aa, artificial
  consensus sequence
  misc_feature (2)..(28): Xaa can be any naturally occurring amino acid
  misc_feature (30)..(30): Xaa can be any naturally occurring amino acid
  misc_feature (35)..(39): Xaa can be any naturally occurring amino acid
  misc_feature (41)..(41): Xaa can be any naturally occurring amino acid
  misc_feature (44)..(56): Xaa can be any naturally occurring amino acid
  misc_feature (58)..(60): Xaa can be any naturally occurring amino acid
  misc_feature (62)..(67): Xaa can be any naturally occurring amino acid
  misc_feature (69)..(82): Xaa can be any naturally occurring amino acid
  misc_feature (84)..(84): Xaa can be any naturally occurring amino acid
  misc_feature (87)..(95): Xaa can be any naturally occurring amino acid
  misc_feature (97)..(97): Xaa can be any naturally occurring amino acid
  misc_feature (99)..(101): Xaa can be any naturally occurring amino acid
  misc_feature (104)..(161): Xaa can be any naturally occurring amino acid
  misc_feature (163)..(163): Xaa can be any naturally occurring amino acid
  misc_feature (165)..(165): Xaa can be any naturally occurring amino acid
  misc_feature (167)..(171): Xaa can be any naturally occurring amino acid
  misc_feature (173)..(174): Xaa can be any naturally occurring amino acid
  misc_feature (176)..(177): Xaa can be any naturally occurring amino acid
  misc_feature (179)..(180): Xaa can be any naturally occurring amino acid
  misc_feature (183)..(185): Xaa can be any naturally occurring amino acid
  misc_feature (187)..(189): Xaa can be any naturally occurring amino acid
  misc_feature (195)..(196): Xaa can be any naturally occurring amino acid
  misc_feature (198)..(203): Xaa can be any naturally occurring amino acid
  misc_feature (205)..(215): Xaa can be any naturally occurring amino acid
  misc_feature (217)..(217): Xaa can be any naturally occurring amino acid
  misc_feature (219)..(219): Xaa can be any naturally occurring amino acid
  misc_feature (222)..(222): Xaa can be any naturally occurring amino acid
  misc_feature (224)..(224): Xaa can be any naturally occurring amino acid
  misc_feature (228)..(228): Xaa can be any naturally occurring amino acid
  misc_feature (230)..(230): Xaa can be any naturally occurring amino acid
  misc_feature (233)..(234): Xaa can be any naturally occurring amino acid
  misc_feature (236)..(243): Xaa can be any naturally occurring amino acid
  misc_feature (245)..(245): Xaa can be any naturally occurring amino acid
  misc_feature (247)..(248): Xaa can be any naturally occurring amino acid
  misc_feature (250)..(250): Xaa can be any naturally occurring amino acid
  misc_feature (253)..(254): Xaa can be any naturally occurring amino acid
  misc_feature (257)..(261): Xaa can be any naturally occurring amino acid
  misc_feature (263)..(266): Xaa can be any naturally occurring amino acid
  misc_feature (269)..(276): Xaa can be any naturally occurring amino acid
  misc_feature (278)..(288): Xaa can be any naturally occurring amino acid
  misc_feature (290)..(291): Xaa can be any naturally occurring amino acid
  misc_feature (293)..(294): Xaa can be any naturally occurring amino acid
  misc_feature (296)..(299): Xaa can be any naturally occurring amino acid
  misc_feature (303)..(303): Xaa can be any naturally occurring amino acid
  misc_feature (306)..(307): Xaa can be any naturally occurring amino acid
  misc_feature (309)..(309): Xaa can be any naturally occurring amino acid
  misc_feature (311)..(311): Xaa can be any naturally occurring amino acid
  misc_feature (313)..(313): Xaa can be any naturally occurring amino acid
  misc_feature (315)..(316): Xaa can be any naturally occurring amino acid
  misc_feature (321)..(327): Xaa can be any naturally occurring amino acid
  misc_feature (329)..(329): Xaa can be any naturally occurring amino acid
  misc_feature (334)..(335): Xaa can be any naturally occurring amino acid
  misc_feature (337)..(340): Xaa can be any naturally occurring amino acid
  misc_feature (342)..(342): Xaa can be any naturally occurring amino acid
  misc_feature (344)..(346): Xaa can be any naturally occurring amino acid
  misc_feature (348)..(348): Xaa can be any naturally occurring amino acid
  misc_feature (350)..(350): Xaa can be any naturally occurring amino acid
  misc_feature (352)..(372): Xaa can be any naturally occurring amino acid
  misc_feature (374)..(377): Xaa can be any naturally occurring amino acid
MXXXXXXXXXXXXXXXXXXXXXXXXXXXYXVQSPXXXXXTXSHXXXXXXXXXXXXXPXXXFXXXXXXRXXXXXXXXXXXXXXEXSRXXXXXXXXXRXSXXXFLXXXXXXXXXXXXXXXXXXXXXXXXXXXXXXXXXXXXXXXXXXXXXXXXXXXXXXXXXXRXVXLXXXXXCXXIXXQXXWRXXXSXXXALLVFXXAXXXXXXPXXXXXXXXXXXFXLXEGXDXSGVXTXFLXXNXXXXXXXXNXSXXFXLHXXPPXXXXXFXXXXFAXXXXXXXXGXXXXXXXXXXXTXXLXXAXXXXPMYXAGXXMXDXLXSXXGLPLXXXXXXXSXYRVVXXLXXXXYXHXXXCXVXLXXXXXXXXXXXXXXXXXXXXXCXXXX

SEQ ID NO: 67885 - protein, 1000 aa, artificial
  consensus sequence
  misc_feature (1)..(498): Xaa can be any naturally occurring amino acid
  misc_feature (601)..(604): Xaa can be any naturally occurring amino acid
  misc_feature (616)..(616): Xaa can be any naturally occurring amino acid
  misc_feature (673)..(673): Xaa can be any naturally occurring amino acid
  misc_feature (814)..(838): Xaa can be any naturally occurring amino acid
  misc_feature (969)..(971): Xaa can be any naturally occurring amino acid
  misc_feature (973)..(973): Xaa can be any naturally occurring amino acid
  misc_feature (975)..(1000): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMLLSLTLFFHFFFIIFNRWEKFDDTEWTILGVEGESERERVMEALKTATFSPMSVLSEKRSEPRKPFSLPNLFPPKSQRPISQESFLKRFNGGLALLTSVLSXXXXAPAKSLTYEEAXLQQSMTTSSSFDSDGLIEGISNFVTDNPLVIAGGVAALAVPFVLSQVLNKKPKSWGXVESAKNAYTKLGTDDNAQLLDIRATADFRQVGSPNIKGLGKKAVSTVYNGEDKPGFLKKLSLKFKDPENTTLYILDKFDGNSELVAELVALNGFKSAYAIKDGAEGPRGWLNSSLPWIEPKKTLSLDLSSLTDSISGVFGXXXXXXXXXXXXXXXXXXXXXXXXXDRKQTLKQVDEFLNTKVAPKELVDELKEIGKALLPQSTSNKALPAPATVTAEAESATATTTTVDKPVPEPETVAATTTTVDKPVPEPEPVPEPVPVPAIEAAVAAQVITEPTETEAKPKPHSRPLSPYASXXXLXPXXXXXXXXXXXXXXXXXXXXXXXXXX

SEQ ID NO: 67886 - protein, 751 aa, artificial
  consensus sequence
  misc_feature (1)..(45): Xaa can be any naturally occurring amino acid
  misc_feature (47)..(54): Xaa can be any naturally occurring amino acid
  misc_feature (56)..(61): Xaa can be any naturally occurring amino acid
  misc_feature (63)..(64): Xaa can be any naturally occurring amino acid
  misc_feature (66)..(68): Xaa can be any naturally occurring amino acid
  misc_feature (70)..(145): Xaa can be any naturally occurring amino acid
  misc_feature (149)..(150): Xaa can be any naturally occurring amino acid
  misc_feature (152)..(153): Xaa can be any naturally occurring amino acid
  misc_feature (156)..(156): Xaa can be any naturally occurring amino acid
  misc_feature (158)..(158): Xaa can be any naturally occurring amino acid
  misc_feature (161)..(161): Xaa can be any naturally occurring amino acid
  misc_feature (164)..(208): Xaa can be any naturally occurring amino acid
  misc_feature (210)..(218): Xaa can be any naturally occurring amino acid
  misc_feature (220)..(224): Xaa can be any naturally occurring amino acid
  misc_feature (226)..(226): Xaa can be any naturally occurring amino acid
  misc_feature (228)..(230): Xaa can be any naturally occurring amino acid
  misc_feature (232)..(233): Xaa can be any naturally occurring amino acid
  misc_feature (235)..(266): Xaa can be any naturally occurring amino acid
  misc_feature (268)..(268): Xaa can be any naturally occurring amino acid
  misc_feature (271)..(271): Xaa can be any naturally occurring amino acid
  misc_feature (274)..(275): Xaa can be any naturally occurring amino acid
  misc_feature (278)..(278): Xaa can be any naturally occurring amino acid
  misc_feature (280)..(280): Xaa can be any naturally occurring amino acid
  misc_feature (282)..(282): Xaa can be any naturally occurring amino acid
  misc_feature (284)..(360): Xaa can be any naturally occurring amino acid
  misc_feature (362)..(751): Xaa can be any naturally occurring amino acid
XXXXXXXXXXXXXXXXXXXXXXXXXXXXXXXXXXXXXXXXXXXXXHXXXXXXXXGXXXXXXFXXGXXXFXXXXXXXXXXXXXXXXXXXXXXXXXXXXXXXXXXXXXXXXXXXXXXXXXXXXXXXXXXXXXXXXXXXXXXXXXXXXLPRXXFXXLQXKXFPXYFXXXXXXXXXXXXXXXXXXXXXXXXXXXXXXXXXXXXXXXXXXXXXLXXXXXXXXXNXXXXXPXTXXXMXXRXXXXXXXXXXXXXXXXXXXXXXXXXXXXXXXXAXNKXFGXXHGXSXLXNXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67887 - protein, 168 aa, artificial
  consensus sequence
  misc_feature (2)..(4): Xaa can be any naturally occurring amino acid
  misc_feature (6)..(7): Xaa can be any naturally occurring amino acid
  misc_feature (9)..(12): Xaa can be any naturally occurring amino acid
  misc_feature (14)..(14): Xaa can be any naturally occurring amino acid
  misc_feature (16)..(16): Xaa can be any naturally occurring amino acid
  misc_feature (18)..(31): Xaa can be any naturally occurring amino acid
  misc_feature (34)..(41): Xaa can be any naturally occurring amino acid
  misc_feature (46)..(46): Xaa can be any naturally occurring amino acid
  misc_feature (48)..(48): Xaa can be any naturally occurring amino acid
  misc_feature (55)..(55): Xaa can be any naturally occurring amino acid
  misc_feature (65)..(65): Xaa can be any naturally occurring amino acid
  misc_feature (67)..(67): Xaa can be any naturally occurring amino acid
  misc_feature (71)..(71): Xaa can be any naturally occurring amino acid
  misc_feature (95)..(95): Xaa can be any naturally occurring amino acid
  misc_feature (101)..(101): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(110): Xaa can be any naturally occurring amino acid
  misc_feature (114)..(115): Xaa can be any naturally occurring amino acid
  misc_feature (120)..(120): Xaa can be any naturally occurring amino acid
  misc_feature (124)..(124): Xaa can be any naturally occurring amino acid
  misc_feature (126)..(126): Xaa can be any naturally occurring amino acid
  misc_feature (144)..(144): Xaa can be any naturally occurring amino acid
  misc_feature (155)..(162): Xaa can be any naturally occurring amino acid
  misc_feature (168)..(168): Xaa can be any naturally occurring amino acid
MXXXSXXLXXXXLXSXFXXXXXXXXXXXXXXRRXXXXXXXXYPRIXAXDLDQNTXVAISVGVVSXAXGIGXPVFYETQIDNAAKRDNTQPCFPCXGSGAQXCRFCXGXGXVTVXXGGGEXEVSXCXNCDGVGSLTCTTCQGSGXIQPRYLDRREXXXXXXXXFKDDDX

SEQ ID NO: 67888 - protein, 141 aa, artificial
  consensus sequence
  misc_feature (1)..(1): Xaa can be any naturally occurring amino acid
  misc_feature (4)..(11): Xaa can be any naturally occurring amino acid
  misc_feature (15)..(15): Xaa can be any naturally occurring amino acid
  misc_feature (17)..(17): Xaa can be any naturally occurring amino acid
  misc_feature (21)..(21): Xaa can be any naturally occurring amino acid
  misc_feature (23)..(23): Xaa can be any naturally occurring amino acid
  misc_feature (27)..(27): Xaa can be any naturally occurring amino acid
  misc_feature (29)..(29): Xaa can be any naturally occurring amino acid
  misc_feature (33)..(34): Xaa can be any naturally occurring amino acid
  misc_feature (36)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (47)..(48): Xaa can be any naturally occurring amino acid
  misc_feature (54)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (66)..(67): Xaa can be any naturally occurring amino acid
  misc_feature (69)..(70): Xaa can be any naturally occurring amino acid
  misc_feature (77)..(79): Xaa can be any naturally occurring amino acid
  misc_feature (81)..(83): Xaa can be any naturally occurring amino acid
  misc_feature (87)..(87): Xaa can be any naturally occurring amino acid
  misc_feature (89)..(89): Xaa can be any naturally occurring amino acid
  misc_feature (104)..(104): Xaa can be any naturally occurring amino acid
  misc_feature (106)..(107): Xaa can be any naturally occurring amino acid
  misc_feature (111)..(112): Xaa can be any naturally occurring amino acid
  misc_feature (114)..(114): Xaa can be any naturally occurring amino acid
  misc_feature (117)..(118): Xaa can be any naturally occurring amino acid
  misc_feature (120)..(123): Xaa can be any naturally occurring amino acid
  misc_feature (125)..(141): Xaa can be any naturally occurring amino acid
XMAXXXXXXXXSMLXSXLLFXVXLSLXEXYRGXXAXSELXTIXGGFXXSLLFLXXLTFIXGNXQEXXGXXTGWGAVXXXAXXXALIXAXTVHRVCITTCFLFSXAXXLYEXXKXSGXXLXXXXSXXXXXXXXXXXXXXXXX

SEQ ID NO: 67889 - protein, 131 aa, artificial
  consensus sequence
  misc_feature (2)..(5): Xaa can be any naturally occurring amino acid
  misc_feature (7)..(8): Xaa can be any naturally occurring amino acid
  misc_feature (12)..(13): Xaa can be any naturally occurring amino acid
  misc_feature (20)..(20): Xaa can be any naturally occurring amino acid
  misc_feature (25)..(25): Xaa can be any naturally occurring amino acid
  misc_feature (29)..(29): Xaa can be any naturally occurring amino acid
  misc_feature (32)..(33): Xaa can be any naturally occurring amino acid
  misc_feature (37)..(37): Xaa can be any naturally occurring amino acid
  misc_feature (41)..(44): Xaa can be any naturally occurring amino acid
  misc_feature (46)..(47): Xaa can be any naturally occurring amino acid
  misc_feature (58)..(58): Xaa can be any naturally occurring amino acid
  misc_feature (65)..(65): Xaa can be any naturally occurring amino acid
  misc_feature (71)..(72): Xaa can be any naturally occurring amino acid
  misc_feature (77)..(77): Xaa can be any naturally occurring amino acid
  misc_feature (80)..(80): Xaa can be any naturally occurring amino acid
  misc_feature (83)..(85): Xaa can be any naturally occurring amino acid
  misc_feature (88)..(88): Xaa can be any naturally occurring amino acid
  misc_feature (90)..(91): Xaa can be any naturally occurring amino acid
  misc_feature (96)..(98): Xaa can be any naturally occurring amino acid
  misc_feature (100)..(100): Xaa can be any naturally occurring amino acid
  misc_feature (102)..(104): Xaa can be any naturally occurring amino acid
  misc_feature (106)..(131): Xaa can be any naturally occurring amino acid
MXXXXVXXKFAXXSMVMWMXPVAIXYGFXYQXXPGVXQLSXXXXTXXSGFLAVISVNXVIGFYIXMAMKEXXHQEPXPDXTFXXXAKXSXXQPTSXXXSXDXXXKXXXXXXXXXXXXXXXXXXXXXXXXXX

SEQ ID NO: 67890 - protein, 1913 aa, artificial
  consensus sequence
  misc_feature (1)..(1158): Xaa can be any naturally occurring amino acid
  misc_feature (1160)..(1303): Xaa can be any naturally occurring amino acid
  misc_feature (1305)..(1306): Xaa can be any naturally occurring amino acid
  misc_feature (1309)..(1325): Xaa can be any naturally occurring amino acid
  misc_feature (1328)..(1331): Xaa can be any naturally occurring amino acid
  misc_feature (1333)..(1361): Xaa can be any naturally occurring amino acid
  misc_feature (1364)..(1389): Xaa can be any naturally occurring amino acid
  misc_feature (1391)..(1408): Xaa can be any naturally occurring amino acid
  misc_feature (1410)..(1418): Xaa can be any naturally occurring amino acid
  misc_feature (1420)..(1423): Xaa can be any naturally occurring amino acid
  misc_feature (1425)..(1425): Xaa can be any naturally occurring amino acid
  misc_feature (1430)..(1430): Xaa can be any naturally occurring amino acid
  misc_feature (1433)..(1435): Xaa can be any naturally occurring amino acid
  misc_feature (1440)..(1441): Xaa can be any naturally occurring amino acid
  misc_feature (1448)..(1448): Xaa can be any naturally occurring amino acid
  misc_feature (1451)..(1452): Xaa can be any naturally occurring amino acid
  misc_feature (1454)..(1457): Xaa can be any naturally occurring amino acid
  misc_feature (1459)..(1461): Xaa can be any naturally occurring amino acid
  misc_feature (1465)..(1465): Xaa can be any naturally occurring amino acid
  misc_feature (1468)..(1468): Xaa can be any naturally occurring amino acid
  misc_feature (1470)..(1492): Xaa can be any naturally occurring amino acid
  misc_feature (1495)..(1499): Xaa can be any naturally occurring amino acid
  misc_feature (1501)..(1501): Xaa can be any naturally occurring amino acid
  misc_feature (1504)..(1504): Xaa can be any naturally occurring amino acid
  misc_feature (1506)..(1507): Xaa can be any naturally occurring amino acid
  misc_feature (1509)..(1513): Xaa can be any naturally occurring amino acid
  misc_feature (1515)..(1524): Xaa can be any naturally occurring amino acid
  misc_feature (1526)..(1531): Xaa can be any naturally occurring amino acid
  misc_feature (1533)..(1541): Xaa can be any naturally occurring amino acid
  misc_feature (1543)..(1544): Xaa can be any naturally occurring amino acid
  misc_feature (1547)..(1547): Xaa can be any naturally occurring amino acid
  misc_feature (1552)..(1552): Xaa can be any naturally occurring amino acid
  misc_feature (1559)..(1584): Xaa can be any naturally occurring amino acid
  misc_feature (1586)..(1913): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXLLXXXXXXXXXXXXXXXXXRLXXXXIXXXXXXXXXXXXXXXXXXXXXXXXXXXXXSPXXXXXXXXXXXXXXXXXXXXXXXXXXEXXXXXXXXXXXXXXXXXXSXXXXXXXXXKXXXXVXIPVDXYPXXXNFVGXXLGPRGNXLKXXEXXXXCXXXIRGXGSXKXXXXXXXXXXXXXXXXXXXXXXXPGXXXXXEXLHXLXXAXXXXXIXXXXXXXXXXIXXXXXXPXXXXXXXXXKXXQLXRELAXLNGTLRXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67891 - protein, 91 aa, artificial
  consensus sequence
  misc_feature (4)..(5): Xaa can be any naturally occurring amino acid
  misc_feature (10)..(10): Xaa can be any naturally occurring amino acid
  misc_feature (12)..(12): Xaa can be any naturally occurring amino acid
  misc_feature (17)..(17): Xaa can be any naturally occurring amino acid
  misc_feature (20)..(20): Xaa can be any naturally occurring amino acid
  misc_feature (68)..(68): Xaa can be any naturally occurring amino acid
  misc_feature (70)..(70): Xaa can be any naturally occurring amino acid
  misc_feature (78)..(78): Xaa can be any naturally occurring amino acid
  misc_feature (83)..(84): Xaa can be any naturally occurring amino acid
  misc_feature (86)..(91): Xaa can be any naturally occurring amino acid
MALXXGDDSXPXASYIXMVXHLIEKCMTFGMSMEECMEALSKRADVQPVVTSTVWKELEKENKEFFDXYXKQLRSEKXGRSSXXSXXXXXX

SEQ ID NO: 67892 - protein, 198 aa, artificial
  consensus sequence
  misc_feature (1)..(34): Xaa can be any naturally occurring amino acid
  misc_feature (36)..(44): Xaa can be any naturally occurring amino acid
  misc_feature (47)..(47): Xaa can be any naturally occurring amino acid
  misc_feature (51)..(52): Xaa can be any naturally occurring amino acid
  misc_feature (55)..(55): Xaa can be any naturally occurring amino acid
  misc_feature (61)..(61): Xaa can be any naturally occurring amino acid
  misc_feature (63)..(63): Xaa can be any naturally occurring amino acid
  misc_feature (67)..(67): Xaa can be any naturally occurring amino acid
  misc_feature (77)..(77): Xaa can be any naturally occurring amino acid
  misc_feature (81)..(81): Xaa can be any naturally occurring amino acid
  misc_feature (83)..(86): Xaa can be any naturally occurring amino acid
  misc_feature (91)..(91): Xaa can be any naturally occurring amino acid
  misc_feature (97)..(97): Xaa can be any naturally occurring amino acid
  misc_feature (105)..(105): Xaa can be any naturally occurring amino acid
  misc_feature (109)..(110): Xaa can be any naturally occurring amino acid
  misc_feature (120)..(120): Xaa can be any naturally occurring amino acid
  misc_feature (123)..(124): Xaa can be any naturally occurring amino acid
  misc_feature (127)..(127): Xaa can be any naturally occurring amino acid
  misc_feature (130)..(198): Xaa can be any naturally occurring amino acid
XXXXXXXXXXXXXXXXXXXXXXXXXXXXXXXXXXKXXXXXXXXXPDXFDPXXPYXDPVAMXEXREHXVREKWIQIEXAKIXRXXXXWCYRXEGVNHXQKCRHLVXQYLXXTRGVGWGKDXRPXXLHXPKXXXXXXXXXXXXXXXXXXXXXXXXXXXXXXXXXXXXXXXXXXXXXXXXXXXXXXXXXXXXXXXXXXXXX

SEQ ID NO: 67893 - protein, 1111 aa, artificial
  consensus sequence
  misc_feature (1)..(193): Xaa can be any naturally occurring amino acid
  misc_feature (195)..(213): Xaa can be any naturally occurring amino acid
  misc_feature (215)..(217): Xaa can be any naturally occurring amino acid
  misc_feature (220)..(222): Xaa can be any naturally occurring amino acid
  misc_feature (224)..(224): Xaa can be any naturally occurring amino acid
  misc_feature (227)..(229): Xaa can be any naturally occurring amino acid
  misc_feature (232)..(233): Xaa can be any naturally occurring amino acid
  misc_feature (235)..(237): Xaa can be any naturally occurring amino acid
  misc_feature (240)..(240): Xaa can be any naturally occurring amino acid
  misc_feature (243)..(243): Xaa can be any naturally occurring amino acid
  misc_feature (246)..(246): Xaa can be any naturally occurring amino acid
  misc_feature (252)..(252): Xaa can be any naturally occurring amino acid
  misc_feature (255)..(256): Xaa can be any naturally occurring amino acid
  misc_feature (258)..(274): Xaa can be any naturally occurring amino acid
  misc_feature (276)..(276): Xaa can be any naturally occurring amino acid
  misc_feature (278)..(287): Xaa can be any naturally occurring amino acid
  misc_feature (289)..(289): Xaa can be any naturally occurring amino acid
  misc_feature (292)..(292): Xaa can be any naturally occurring amino acid
  misc_feature (296)..(320): Xaa can be any naturally occurring amino acid
  misc_feature (324)..(324): Xaa can be any naturally occurring amino acid
  misc_feature (327)..(327): Xaa can be any naturally occurring amino acid
  misc_feature (331)..(332): Xaa can be any naturally occurring amino acid
  misc_feature (335)..(336): Xaa can be any naturally occurring amino acid
  misc_feature (338)..(338): Xaa can be any naturally occurring amino acid
  misc_feature (343)..(345): Xaa can be any naturally occurring amino acid
  misc_feature (355)..(355): Xaa can be any naturally occurring amino acid
  misc_feature (358)..(395): Xaa can be any naturally occurring amino acid
  misc_feature (397)..(397): Xaa can be any naturally occurring amino acid
  misc_feature (399)..(399): Xaa can be any naturally occurring amino acid
  misc_feature (401)..(403): Xaa can be any naturally occurring amino acid
  misc_feature (407)..(411): Xaa can be any naturally occurring amino acid
  misc_feature (413)..(425): Xaa can be any naturally occurring amino acid
  misc_feature (438)..(438): Xaa can be any naturally occurring amino acid
  misc_feature (440)..(440): Xaa can be any naturally occurring amino acid
  misc_feature (443)..(452): Xaa can be any naturally occurring amino acid
  misc_feature (454)..(458): Xaa can be any naturally occurring amino acid
  misc_feature (462)..(467): Xaa can be any naturally occurring amino acid
  misc_feature (469)..(469): Xaa can be any naturally occurring amino acid
  misc_feature (473)..(483): Xaa can be any naturally occurring amino acid
  misc_feature (486)..(488): Xaa can be any naturally occurring amino acid
  misc_feature (490)..(492): Xaa can be any naturally occurring amino acid
  misc_feature (494)..(497): Xaa can be any naturally occurring amino acid
  misc_feature (499)..(499): Xaa can be any naturally occurring amino acid
  misc_feature (502)..(512): Xaa can be any naturally occurring amino acid
  misc_feature (514)..(515): Xaa can be any naturally occurring amino acid
  misc_feature (517)..(559): Xaa can be any naturally occurring amino acid
  misc_feature (561)..(563): Xaa can be any naturally occurring amino acid
  misc_feature (565)..(1111): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXSXXXELXXXGXVLXXXQDXXSXXXGTXVWXSSXVLVKFXERXXRXXXXXXXXXXXXXXXXXDXAXXXXXXXXXXGXRAXELGXXXXXXXXXXXXXXXXXXXXXXXXXGCGXAGXGLSXXLGXXDXVLTDXXXVLPALRRNLXRNXXXXXXXXXXXXXXXXXXXXXXXXXXXXXXXXXXXXXXAXLXWXXXAHLXXXXXPXXXXXXXXXXXXXFDLVVAADVVYVXEXVPXXXXXXXXXXLXXXXXALAXXXXXXVXLGYXXXXXXXXXXXRSXXXHXXXWXXXXAXFPXXXXXXXXXXXDXXYXXXXXXXXXXXXXXXXXXXXXXXXXXXXXXXXXXXXXXXXXXXDXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 67894 - protein, 359 aa, artificial
  consensus sequence
  misc_feature (1)..(116): Xaa can be any naturally occurring amino acid
  misc_feature (118)..(121): Xaa can be any naturally occurring amino acid
  misc_feature (125)..(126): Xaa can be any naturally occurring amino acid
  misc_feature (130)..(130): Xaa can be any naturally occurring amino acid
  misc_feature (132)..(132): Xaa can be any naturally occurring amino acid
  misc_feature (139)..(140): Xaa can be any naturally occurring amino acid
  misc_feature (144)..(144): Xaa can be any naturally occurring amino acid
  misc_feature (146)..(148): Xaa can be any naturally occurring amino acid
  misc_feature (150)..(151): Xaa can be any naturally occurring amino acid
  misc_feature (155)..(156): Xaa can be any naturally occurring amino acid
  misc_feature (158)..(159): Xaa can be any naturally occurring amino acid
  misc_feature (161)..(163): Xaa can be any naturally occurring amino acid
  misc_feature (166)..(171): Xaa can be any naturally occurring amino acid
  misc_feature (173)..(173): Xaa can be any naturally occurring amino acid
  misc_feature (175)..(179): Xaa can be any naturally occurring amino acid
  misc_feature (181)..(181): Xaa can be any naturally occurring amino acid
  misc_feature (184)..(185): Xaa can be any naturally occurring amino acid
  misc_feature (188)..(188): Xaa can be any naturally occurring amino acid
  misc_feature (190)..(192): Xaa can be any naturally occurring amino acid
  misc_feature (194)..(194): Xaa can be any naturally occurring amino acid
  misc_feature (198)..(198): Xaa can be any naturally occurring amino acid
  misc_feature (200)..(203): Xaa can be any naturally occurring amino acid
  misc_feature (205)..(206): Xaa can be any naturally occurring amino acid
  misc_feature (209)..(211): Xaa can be any naturally occurring amino acid
  misc_feature (213)..(215): Xaa can be any naturally occurring amino acid
  misc_feature (219)..(219): Xaa can be any naturally occurring amino acid
  misc_feature (223)..(223): Xaa can be any naturally occurring amino acid
  misc_feature (225)..(275): Xaa can be any naturally occurring amino acid
  misc_feature (277)..(282): Xaa can be any naturally occurring amino acid
  misc_feature (284)..(285): Xaa can be any naturally occurring amino acid
  misc_feature (287)..(289): Xaa can be any naturally occurring amino acid
  misc_feature (291)..(291): Xaa can be any naturally occurring amino acid
  misc_feature (293)..(293): Xaa can be any naturally occurring amino acid
  misc_feature (296)..(300): Xaa can be any naturally occurring amino acid
  misc_feature (302)..(304): Xaa can be any naturally occurring amino acid
  misc_feature (306)..(317): Xaa can be any naturally occurring amino acid
  misc_feature (319)..(319): Xaa can be any naturally occurring amino acid
  misc_feature (321)..(321): Xaa can be any naturally occurring amino acid
  misc_feature (323)..(323): Xaa can be any naturally occurring amino acid
  misc_feature (326)..(326): Xaa can be any naturally occurring amino acid
  misc_feature (328)..(333): Xaa can be any naturally occurring amino acid
  misc_feature (335)..(359): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXMLQXXKVRXTXFLDERSXXYLTXFXXXAXXEFDXXGXXAXXXLDXXXXXXIXEXXXXXSXMQXXEEXAXXXRXEIEXNXXXXLXXFEXXXEXXXNEGXFFKXLXXXXXXXXXXXXXXXXXXXXXXXXXXXXXXXXXXXXXXXXXXXXXXXXXXXKXXXXXXEXXGXXXRXNXYLXXXXXLXXXIXXXXXXXXXXXXWXKXAXLGXIXXXXXXQXXXXXXXXXXXXXXXXXXXXXXXXX
